(12) United States Patent
Torres et al.

(10) Patent No.: US 9,644,023 B2
(45) Date of Patent: May 9, 2017

(54) COMPOSITIONS AND METHODS FOR PHAGOCYTE DELIVERY OF ANTI-STAPHYLOCOCCAL AGENTS

(71) Applicants: New York University, New York, NY (US); Janssen Biotech, Inc., Horsham, PA (US)

(72) Inventors: Victor J. Torres, New York, NY (US); Randall J. Brezski, Alameda, CA (US); Anthony Lynch, Spring House, PA (US); William Strohl, Spring House, PA (US); Brian Whitaker, Spring House, PA (US); Mark Chiu, Spring House, PA (US); Peter T. Buckley, Spring House, PA (US); Keri Dorn, Spring House, PA (US); Michelle Kinder, Spring House, PA (US)

(73) Assignees: New York University, New York, NY (US); Janssen Biotech, Inc., Horsham, PA (US)

( * ) Notice: Subject to any disclaimer, the term of this patent is extended or adjusted under 35 U.S.C. 154(b) by 0 days.

(21) Appl. No.: 14/565,069

(22) Filed: Dec. 9, 2014

(65) Prior Publication Data
US 2015/0210756 A1  Jul. 30, 2015

Related U.S. Application Data

(60) Provisional application No. 61/913,714, filed on Dec. 9, 2013.

(51) Int. Cl.
| C07K 19/00 | (2006.01) |
| C07K 16/12 | (2006.01) |
| G01N 33/569 | (2006.01) |

(52) U.S. Cl.
CPC ...  *C07K 16/1271* (2013.01); *G01N 33/56938* (2013.01); *C07K 2317/30* (2013.01); *C07K 2317/31* (2013.01); *C07K 2318/00* (2013.01); *G01N 2469/10* (2013.01)

(58) Field of Classification Search
None
See application file for complete search history.

(56) References Cited

U.S. PATENT DOCUMENTS

| 7,364,738 | B2 | 4/2008 | Patti et al. |
| 8,569,227 | B2 | 10/2013 | Jacobs |
| 2011/0135657 | A1 | 6/2011 | Hu et al. |
| 2011/0274693 | A1 | 11/2011 | Torres et al. |
| 2013/0245238 | A1 | 9/2013 | Davis et al. |
| 2013/0274145 | A1 | 10/2013 | Jacobs et al. |

FOREIGN PATENT DOCUMENTS

| EP | 2 500 035 A1 | 9/2012 |
| GB | 2 405 873 A | 3/2005 |
| WO | 2007/016240 A2 | 2/2007 |
| WO | 2007/141274 A2 | 12/2007 |
| WO | 2008/079246 A2 | 7/2008 |
| WO | 2013/049275 A1 | 4/2013 |
| WO | 2013/096948 A1 | 6/2013 |
| WO | 2013/156534 A1 | 10/2013 |
| WO | 2015/089073 A2 | 6/2015 |

OTHER PUBLICATIONS

Brezski et al., "Tumor-Associated and Microbial Proteases Compromise Host IgG Effector Functions by a Single Cleavage Proximal to the Hinge," Proc. Nat'l. Acad. Sci. U.S.A. 106(42):17864-17869 (2009).
Kuo et al., "Neonatal Fc Receptor and IgG-Based Therapeutics," mAbs 3(5):422-430 (2011).
International Search Report for corresponding PCT/US14/69347 (Jul. 28, 2015).
Written Opinion for corresponding PCT/US14/69347 (Jul. 28, 2015).
Atkins et al., "*S. aureus* IgG-binding Proteins SpA and Sbi: Host Specificity and Mechanisms of Immune Complex Formation," Molecular Immunology 45:1600-1611 (2008).
Smith et al., "The Sbi Protein is a Multifunctional Immune Evasion Factor of *Staphylococcus aureus*," Infection and Immunity 79(9):3801-3809 (2011).
Smith et al., "The Immune Evasion Protein Sbi of *Staphylococcus aureus* Occurs Both Extracellularly and Anchored to the Cell Envelope by Binding Lipoteichoic Acid," Molecular Microbiology 83(4):789-804 (2012).
Zhang et al., "A Second IgG-binding Protein in *Staphylococcus aureus*," Microbiology 144:985-991 (1998).
International Preliminary Report on Patentability for PCT/US2014/069347 dated Jun. 23, 2016.

*Primary Examiner* — Brian J Gangle
(74) *Attorney, Agent, or Firm* — LeClairRyan, a Professional Corporation

(57) ABSTRACT

The present application generally relates to multi-specific molecules that bind to multiple bacterial virulence factors, methods for producing these binding molecules, and the use of these binding molecules to treat bacterial infections. In particular, the binding molecules comprise at least two binding domains, preferably an antibody or antibody fragment and an alternative scaffold. The first binding domain is capable of binding to a glycosylated staphylococcal surface protein, preferably an SDR-containing protein. The second binding domain is capable of binding to a staphylococcal leukotoxin, preferably LukAB, LukD or LukE. These multi-specific binding compounds have killing activity against staphylococci and, thus, can be used in the treatment and/or amelioration of a *Staphylococcus* infection, including methicillin-resistant *Staphylococcus aureus*.

24 Claims, 32 Drawing Sheets

FIGURE 4C

COMPOSITIONS AND METHODS FOR PHAGOCYTE DELIVERY OF ANTI-STAPHYLOCOCCAL AGENTS

This application claims the benefit of U.S. Provisional Patent Application Ser. No. 61/913,714, filed Dec. 9, 2013, which is hereby incorporated by reference in its entirety.

FIELD OF THE INVENTION

This invention relates generally to multi-specific binding molecules that target at least two different bacterial virulence factors. In particular, the binding molecules comprise at least two binding domains that specifically bind to different staphylococcal proteins (i.e., the molecules are at least bispecific). The first binding domain, preferably an antibody or a fragment thereof, is capable of binding to a glycosylated staphylococcal surface protein, preferably glycosylated serine-aspartate dipeptide repeat (SDR) containing proteins. The second binding domain, preferably an alternative scaffold, is capable of binding to a staphylococcal leukotoxin, preferably LukAB, LukD or LukE. These multi-specific binding compounds have killing activity against staphylococci and, thus, can be used in the prevention, treatment and/or amelioration of a *Staphylococcus aureus* infection, including methicillin-resistant *Staphylococcus aureus* (MRSA) infections.

BACKGROUND

Bacterial infections caused by *staphylococcus* bacteria (i.e., a "staph infection") are very common in the general population. About 25% of individuals commonly carry *staphylococcus* bacteria on their skin or in their nose. Most of the time, these bacteria cause no problem or result in relatively minor skin infections. However, staph infections can turn deadly if the bacteria invade deeper into an individual's body, for example, entering the bloodstream, joints, bones, lungs or heart. In the past, a lethal staph infection might have occurred in a person who was hospitalized or had a chronic illness or weakened immune system. Now, it is increasingly common for an otherwise healthy individual to develop life-threatening staph infections. Importantly, many staph infections no longer respond to common antibiotics.

*Staphylococcus aureus*, often referred to as "staph," Staph. *aureus*," or "*S. aureus*," is a major human pathogen, producing a multitude of virulence factors making it able to cause several types of infection, from superficial lesions to toxinoses and life-threatening systemic conditions such as endocarditis, osteomyelitis, pneumonia, meningitis and sepsis (reviewed in Miller and Cho, "Immunity Against *Staphylococcus aureus* Cutaneous Infections," *Nat. Rev. Immunol.* 11:505-518 (2011)). Although most individuals encounter *S. aureus* shortly after birth (Holtfreter et al., "Towards the Immune Proteome of *Staphylococcus aureus*—The Anti-*S. aureus* Antibody Response," *Int. J. Med. Microbiol.* 300: 176-192 (2010)) and possess both antibodies against *S. aureus* and the ability to increase anti-*S. aureus* titers after infection, these antibodies are often not protective against recurrent *S. aureus* infections (Foster T J, "Immune Evasion by Staphylococci," *Nat. Rev. Microbiol.* 3:948-958 (2005)). In the United States alone, an annual mortality of more than 20,000 is attributed to methicillin-resistant *S. aureus* (MRSA), exceeding deaths caused by influenza, viral hepatitis, and HIV/AIDS (Foster, T J., "Immune Evasion by Staphylococci," *Nat. Rev. Microbiol.* 3:948-958 (2005); Klevens et al., "The Impact of Antimicrobial-Resistant, Health Care-Associated Infections on Mortality in the United States," *Clin. Infect. Dis.* 47:927-930 (2008)). The pathogen produces a variety of molecules that presumably facilitate survival in or on the human host.

Bi-component, pore-forming leukotoxins are among the secreted virulence factors produced by *S. aureus*. These toxins can be secreted as water soluble monomers which oligomerize, and then insert pores into the plasma membrane, which subsequently disrupt the cellular osmotic balance and membrane potential leading to death of the targeted cells, most notably polymorphonuclear leukocytes (PMNs) and mononuclear phagocytes (Bischogberger et al., "Pathogenic Pore-Forming Proteins: Function and Host Response," *Cell Host Microbe* 12(3):266-275 (2012), which is hereby incorporated by reference in its entirety). In the case of Leukotoxin ED (LukED), the targeting, binding, and killing of host phagocytic cells occurs via the cellular target CCR5, CXCR1 and CXCR2 located on the surface of the phagocytes (Alonzo III et al., "*Staphylococcus aureus* Leucocidin ED Contributes to Systemic Infection by Targeting Neutrophils and Promoting Bacterial Growth *In Vivo*," *Mol. Microbiol.* 83:423-435 (2012); Alonzo III et al. "CCR5 is a Receptor for *Staphylococcus aureus* Leukotoxin ED," *Nature* 493(7430)51-55 (2012); and Reyes-Robles et al., "*Staphylococcus aureus* Leukotoxin ED Targets the Chemokine Receptors CXCR1 and CXCR2 to Kill Leukocytes and Promote Infection," *Cell Host & Microbe* 14:453-459 (2013)). Indeed, when the cellular target of LukED, CCR5, is not present on host immune cells, the host animal is resistant to the otherwise lethal *S. aureus* infection (Alonzo III et al. "CCR5 is a Receptor for *Staphylococcus aureus* Leukotoxin ED," *Nature* 493(7430):51-55 (2012)). Leukotoxin AB (LukAB) can also kill host phagocytic cells, and its cytolytic activity can be exerted both from the outside and from the inside of the cell, after the microorganism is phagocytosed into the host cell (Dumont et al., "*Staphylococcus aureus* LukAB Cytotoxin Kills Human Neutrophils by Targeting the CD11b Subunit of the Integrin Mac-1," *PNAS* 110(26):10794-10799 (2013)). Due to the contribution that both of these leukotoxins have to pathogenesis, they have been considered critical *S. aureus* virulence factors (Alonzo III and Tones, "Bacterial Survival Amidst an Immune Onslaught: The Contribution of the *Staphylococcus aureus* Leukotoxins," *PLOS Path* 9(2):e1003143 (2013)).

Another critical factor for the pathogenic success of *S. aureus* depends on the properties of its surface proteins (Clarke et al., "Surface Adhesins of *Staphylococcus aureus*," *Adv. Microb. Physiol.* 51:187-224 (2006); Patti et al., "MSCRAMM-Mediated Adherence of Microorganisms to Host Tissues," *Annu. Rev. Microbiol.* 48:585-617 (1994); and Patti et al., "Microbial Adhesins Recognizing Extracellular Matrix Macromolecules," *Curr. Opin. Cell Biol.* 6:752-758 (1994)).

*S. aureus* employs microbial surface components recognizing adhesive matrix molecules (MSCRAMMs) in order to adhere to and colonize host tissues. MSCRAMMs can recognize collagen, heparin-related polysaccharides, fibrinogen, and/or fibronectin. *S. aureus* expresses a subset of MSCRAMMs, which all contain the serine-aspartate dipeptide repeat (SDR) domain, including clumping factor A (ClfA), clumping factor B (ClfB), SdrC, SdrD, and SdrE (Becherelli et al. "Protective Activity of the CnaBE3 Domain Conserved Among *Staphylococcus aureus* Sdr Proteins," *PLoS One* 8(9): e74718 (2013)). *S. epidermidis* also expresses three members of this family, SdrF, SdrG, and SdrH (McCrea et al., "The Serine-Aspartate Repeat (Sdr) Protein Family in *Staphylococcus Epidermidis*," *Microbiol-* ogy 146:1535-1546 (2000)). All of these proteins share a similar structure comprising an N-terminal ligand-binding A domain followed by the SDR domain, which can contain between 25-275 serine-aspartate dipeptide repeats. The C-terminal portion of these proteins contains the LPXTG-motif, which facilitates cell wall anchoring by the transpeptidase sortase A. The serine-aspartate dipeptide regions in SDR-containing proteins are modified by the sequential addition of glycans by two glycosyltransferases. First, SdgB appends N-acetylglucosamine (GlcNAc) on serine residues within the serine-aspartate dipeptide regions, followed by SdgA modification of the glycoprotein, resulting in disaccharide moieties. This glycosylation can protect SDR-containing staphylococcal proteins from Cathepsin G-mediated degradation (Hazenbos et al., "Novel Staphylococcal Glycosyltransferases SdgA and SdgB Mediate Immunogenicity and Protection of Virulence-Associated Cell Wall Proteins," *PLoS Pathog* 9(10):e1003653 (2013)).

Additionally, Protein A, also located on the surface of *S. aureus*, contributes to staphylococcal escape from protective immune responses by capturing the Fc domain of host IgG, as well as the Fab domain of the VH3 clan of IgG and IgM (Sjodahl et al., "Repetitive Sequences in Protein A from *Staphylococcus aureus*. Arrangement of Five Regions Within the Protein, Four Being Highly Homologous and Fc-Binding," *Eur. J. Biochem.* 73:343-351 (1997); and Cary et al., "The Murine Clan V(H) III Related 7183, J606 and S107 and DNA4 Families Commonly Encode for Binding to a Bacterial B cell Superantigen," *Mol. Immunol.* 36:769-776 (1999)).

Additionally, *S. aureus* expresses a second immunoglobulin binding protein referred to as the second binding protein for immunoglobulins (Sbi) (Zhang et al., "A Second IgG-Binding Protein in *Staphylococcus aureus*," *Microbiology* 144:985-991 (1998) and Atkins et al., "*S. aureus* IgG-binding Proteins SpA and Sbi: Host Specificity and mechanisms of Immune Complex Formation," *Mol. Immunol.* 45:1600-1611 (2008)) that is either secreted or associated with the cell envelope (Smith et al., "The Sbi Protein is a Multifunctional Immune Evasion Factor of *Staphylococcus aureus*" Infection & Immunity 79:3801-3809 (2011) and Smith et al., "The Immune Evasion Protein Sbi of *Staphylococcus aureus* Occurs both Extracellularly and Anchored to the Cell Envelope by Binding to Lipotechoic Acid" *Mol. Microbiol.* 83:789-804 (2012)) and shares a pair of conserved helices with Protein A involved in binding to the Fc region of IgG proteins (Atkins et al., "*S. aureus* IgG-binding Proteins SpA and Sbi: Host Specificity and mechanisms of Immune Complex Formation," *Mol. Immunol.* 45:1600-1611 (2008)).

Furthermore, *S. aureus* secretes a number of proteases that have been implicated in immune evasion. Rooijakkers et al. demonstrated that *S. aureus* secretion of staphylokinase, a plasminogen activator protein, led to the activation of plasmin that cleaved both surface-bound IgG and complement C3b, ultimately reducing immune-mediated *S. aureus* destruction (Rooijakkers et al., "Anti-Opsonic Properties of Staphylokinase," *Microbes and Infection* 7:476-484 (2005)). *S. aureus* also secretes the serine protease glutamyl endopeptidase V8 (GluV8) that can directly cleave human IgG1 in the lower hinge region between E233 and L234 (EU numbering (Edelman et al., "The Covalent Structure of an Entire GammaG Immunoglobulin Molecule," *PNAS* 63:78-85 (1969), Brerski et al., "Human Anti-IgG1 Hinge Autoantibodies Reconstitute the Effector Functions of Proteolytically Inactivated IgGs," *J. Immunol.* 181:3183-3192 (2008)). It was also recently demonstrated that human anti-*S. aureus* IgGs are rapidly cleaved when bound to the surface of *S. aureus* (Fernandez Falcon et al., "Protease Inhibitors Decrease IgG Shedding From *Staphylococcus aureus*, Increasing Complement Activation and Phagocytosis Efficiency," *J. Med. Microbiol.* 60:1415-1422 (2011)).

Taken together, these studies indicate that *S. aureus* utilizes a number of mechanisms that could adversely affect standard IgG1-based monoclonal antibody (mAb) therapeutics, either by directly cleaving the mAb, sequestering the mAb by Protein A binding, or by killing off the very effector cells required for therapeutic efficacy. It is therefore not surprising that presently there are no mAb-based therapies targeting *S. aureus* that have achieved final approval for use in humans. Thus, there remains a need for methods and compositions that can treat staphylococcal infection, which (i) evade protein A and Sbi binding, (ii) escape staph-induced proteolysis, (iii) can neutralize leukotoxins and (iv) are capable of opsonizing and delivering *S. aureus* to phagocytes. The present application meets these and other needs.

Summary

The present disclosure provides multi-specific binding molecules comprising at least a first binding domain and a second binding domain, each of which specifically binds to a different bacterial virulence factor in particular a different staphylococcal virulence factor. The first and the second binding domains are optionally connected via a linker peptide.

The first binding domain is capable of binding to a glycosylated staphylococcal surface protein, such as an staphylococcal SDR-containing protein. In one aspect, the staphylococcal SDR-containing protein is ClfA, ClfB, SdrC, SdrD, SdrE, SdrF, SdrG and SdrH. Preferably, the staphylococcal SDR-containing protein is ClfA, ClfB, SdrC, SdrD or SdrE.

In one aspect, the first binding domain is a full-length antibody or antibody fragment. Preferably, the full-length antibody or antibody fragment is resistant to proteolytic degradation by a staphylococcal protease that cleaves wild-type IgG1 (such as a staphylococcal protease, e.g., *Staphylococcus aureus* V8 protease, that cleaves wild-type IgG1 between or at residues 222-237 (EU numbering) within SEQ ID NO:60). In another aspect, the full-length antibody or antibody fragment is a human, humanized, or chimeric antibody or antibody fragment.

In one aspect, the binding molecule is not capable of specific binding to human FcγRI, is not capable of specific binding to Protein A, and is not capable of specific binding to Sbi. In one aspect, the binding molecule is capable of specific binding to FcRn.

In one aspect, the first binding domain comprises an immunoglobulin heavy chain variable (VH) region having the amino acid sequence selected from the group of VH region amino acid sequences of SEQ ID NOs:60, 62, 64 or 66. In another aspect, the first binding domain comprises an immunoglobulin light chain variable (VL) region having the amino acid sequence of SEQ ID NOs:61, 63, 65 or 67. Alternatively, the first binding domain comprises (a) a VH region having the amino acid sequence of SEQ ID NOs:60, 62, 64 or 66; and (b) a VL region having the amino acid sequence of SEQ ID NOs:61, 63, 65 or 67. In one embodiment, the first binding domain comprises (1) a VH region having the amino acid sequence of SEQ ID NO:60, and a VL region having the amino acid sequence of SEQ ID NO:61; (2) a VH region having the amino acid sequence of SEQ ID NO:62, and a VL region having the amino acid sequence of SEQ ID NO:63; (3) a VH region having the amino acid sequence of SEQ ID NO:64, and a VL region having the amino acid sequence of SEQ ID NO:65; (4) a VH region having the amino acid sequence of SEQ ID NO:66, and a VL region having the amino acid sequence of SEQ ID NO:67; (5) a VH region having the amino acid sequence of SEQ ID NO:68, and a VL region having the amino acid sequence of SEQ ID NO:69; (6) a VH region having the amino acid sequence of SEQ ID NO:70, and a VL region having the amino acid sequence of SEQ ID NO:71; (7) a VH region having the amino acid sequence of SEQ ID NO:72, and a VL region having the amino acid sequence of SEQ ID NO:73; (8) a VH region having the amino acid sequence of SEQ ID NO:74, and a VL region having the amino acid sequence of SEQ ID NO:75; (9) a VH region having the amino acid sequence of SEQ ID NO:76, and a VL region having the amino acid sequence of SEQ ID NO:77; or (10) a VH region having the amino acid sequence of SEQ ID NO:78, and a VL region having the amino acid sequence of SEQ ID NO:79.

In yet another aspect, the binding molecule comprises (a) a first binding domain that comprises (i) a VH region having the amino acid sequence of SEQ ID NOs:60, 62, 64 or 66; and (ii) a VL region having the amino acid sequence of SEQ ID NOs:61, 63, 65 or 67; and (b) a second binding domain that comprises the amino acid sequence of any one of SEQ ID NOs:14-59 or SEQ ID NOs:113-666. In once aspect, the second binding domain comprises the amino acid sequence of SEQ ID NO:14 or SEQ ID NO:22.

The second binding domain is capable of binding to a staphylococcal leukotoxin. In one aspect, the staphylococcal leukotoxin is selected from a group consisting of leukotoxin A (LukA), leukotoxin B (LukB), leukotoxin AB (LukAB), leukotoxin D (LukD), leukotoxin E (LukE), leukotoxin ED (LukED), Panton-Valentine leukocidin S (LukS-PV), Panton-Valentine leukocidin F (LukF-PV), Panton-Valentine leukocidin (LukSF/PVL), gamma hemolysin A (HlgA), gamma hemolysin C (HlgC), gamma hemolysin B (HlgB), gamma hemolysin AB (HlgAB), and gamma-hemolysin BC (HlgBC). In one aspect, the staphylococcal leukotoxin is LukAB, LukD, or LukE.

In one aspect, the second binding domain is an alternative scaffold. In one aspect, the alternative scaffold comprises a fibronectin type III (FN3) domain. In one aspect, the FN3 domain binds to LukA having the amino acid sequence of SEQ ID NO:10, LukB having the amino acid sequence of SEQ ID NO:11, LukD having the amino acid sequence of SEQ ID NO:12, or LukE having the amino acid sequence of SEQ ID NO:13. Alternatively, the FN3 domain binds to a LukAB complex comprising LukA having the amino acid sequence of SEQ ID NO:10 and LukB having the amino acid sequence of SEQ ID NO:11, and/or a LukED complex comprising LukE having the amino acid sequence of SEQ ID NO:13 and LukD having the amino acid sequence of SEQ ID NO:12.

In one aspect, the second binding domain of the binding molecule competes with an FN3 domain having an amino acid sequence of any one of SEQ ID NOs:14-59 or SEQ ID NOs:113-666 for binding to (i) LukA having the amino acid sequence of SEQ ID NO:10; (ii) LukB having the amino acid sequence of SEQ ID NO:11; (iii) LukD having the amino acid sequence of SEQ ID NO:12; and/or (iv) LukE having the amino acid sequence of SEQ ID NO:13.

In one aspect, the second binding domain is a FN3 domain comprising an amino acid sequence selected from the group consisting of SEQ ID NOs:14-59 and SEQ ID NOs:113-666. In one aspect, the second binding domain is a FN3 domain comprising the amino acid sequence of SEQ ID NO:14 or SEQ ID NO:22.

In one aspect, the binding molecule further comprises one or more additional binding domains, where the one or more additional binding domains are capable of (i) binding to a different glycosylated staphylococcal surface protein than bound by the first binding domain and/or (ii) binding to a different staphylococcal leukotoxin than bound by the second binding domain.

The disclosure also provides nucleic acid sequences encoding the above described binding molecules as well as vectors comprising a nucleic acid sequence or nucleic acid sequences. Additionally, the invention contemplates a host cell comprising these vectors.

Moreover, the disclosure provides a process for the production of the above described binding molecules, comprising (a) culturing a host cell containing a vector comprising a nucleic acid sequence or nucleic acid sequences that encode the inventive binding molecules, and (b) recovering the binding molecule from the culture.

Furthermore, the disclosure provides a pharmaceutical composition comprising a binding molecule as described herein.

The binding molecules provided herein can be used in the treatment, prevention or amelioration of a staphylococcal infection. In one aspect, the staphylococcal infection is caused by *Staphylococcus aureus*, including methicillin-resistant *Staphylococcus aureus* (MRSA) and methicillin-sensitive *Staphylococcus aureus* (MSSA). Accordingly, the present disclosure provides a method for the treatment, prevention or amelioration of a staphylococcal infection, comprising (a) administering to a subject in need thereof a binding molecule as described herein. This method of treatment, prevention of amelioration of staphylococcal infection may involve repeated administration of the binding molecule as described herein, or administration of the binding molecule in combination with one or more other agents, such as an anti-infective agent, an antibiotic agent, and/or an antimicrobial agent.

The binding molecules provided herein can also be used in methods for diagnosing a staphylococcal infection in a subject. In one aspect, the method for diagnosing a staphylococcal infection involves contacting the binding molecule as described herein with a sample from a subject and detecting the presence or the absence of a glycosylated staphylococcal surface protein and/or a staphylococcal leukotoxin in the sample based on the contacting. This method further involves diagnosing the staphylococcal infection in the subject based on the detection of the glycosylated staphylococcal surface protein and/or the staphylococcal leukotoxin in the sample.

Similar methods can be employed for the detection of a *staphylococcus* in a sample. In particular, the methods for detection of *staphylococcus* in a sample involve contacting the binding molecule as described herein with a sample, and detecting the presence or the absence of a glycosylated *staphylococcus* surface protein and/or a staphylococcal leukotoxin in the sample based on the contacting, whereby the presence of the glycosylated *staphylococcus* surface protein and/or staphylococcal leukotoxin indicates the presence of *staphylococcus* in the sample.

Furthermore, the binding molecules of the present invention can be used for the prevention of a staphylococcal infection. In one aspect, a method for the prevention of a staphylococcal infection involves contacting the binding molecule described herein with a sample from the subject, and detecting a glycosylated staphylococcal surface protein and/or a staphylococcal leukotoxin in the sample as a result of the contacting. The method further involves administering an agent suitable for preventing staphylococcal infection to the subject based on the detection of a glycosylated staphylococcal surface protein and/or a staphylococcal leukotoxin in the sample.

Also contemplated by the present disclosure is a kit comprising a binding molecule as provided herein, and a kit comprising a nucleic acid molecule encoding the binding molecules provided, a vector comprising a nucleic acid molecule(s) encoding the binding molecules provided and/ or a host cell containing such a vector.

BRIEF DESCRIPTION OF THE DRAWINGS

FIG. 1A shows data obtained from Cell Titer measurement (cell metabolism). FIG. 1B shows obtained from LDH measurements (membrane damage).

FIG. 2A shows data obtained from ethidium bromide permeability assay (EtBr) (pore-formation/membrane permeability). FIG. 2B shows data obtained from LDH measurements (membrane damage).

FIGS. 4A-4F depict exemplary multispecific binding proteins containing an antibody variable region that targets a Staph antigen conjugated to a leukotoxin neutralizing domain. FIG. 4A shows an exemplary multispecific binding protein containing a monospecific, bivalent anti-Staph mAb variable domain and a heavy chain C-terminal conjugated LukAB, LukD or LukE neutralizing domain. FIG. 4B illustrates an exemplary multispecific binding protein containing a monospecific, bivalent anti-Staph mAb variable domain and a light chain C-terminal conjugated LukAB, LukD or LukE neutralizing domain. FIG. 4C shows an exemplary multispecific binding protein containing a monospecific, bivalent anti-Staph mAb variable domain as well as a light chain C-terminal conjugated LukAB, LukD or LukE neutralizing domain and a heavy chain C-terminal conjugated LukAB, LukD or LukE neutralizing domain. FIG. 4D shows an exemplary multispecific binding protein containing a monospecific, bivalent anti-Staph mAb variable domain and a heavy chain C-terminal conjugated LukAB, LukD or LukE neutralizing domain with a tandem C-terminal conjugated LukAB, LukD or LukE neutralizing domain. FIG. 4E show an exemplary multispecific binding protein containing a bispecific anti-Staph mAb variable domain and a heavy chain C-terminal conjugated LukAB neutralizing domain and a heavy chain C-terminal conjugated LukAB neutralizing domain and a heavy chain C-terminal conjugated LukD or LukE neutralizing domain. FIG. 4F illustrates an exemplary multispecific binding protein containing a monospecific, bivalent anti-Staph mAb and a heavy chain C-terminal conjugated LukAB neutralizing domain and a heavy chain C-terminal conjugated LukD or LukE neutralizing domains.

As shown in FIG. 12, these experiments demonstrate that in comparison to the IgG1 isotype control, both A6 construct 3 and PRASA A6 construct 4 promote hPMN-mediated *S. aureus* growth-restriction. This is consistent with the opsonic capability of the 5133 mAb. Importantly, the LukAB FN3 domain-mAb 5133 conjugates (PRASA A6 HC-AB construct 6 and PRASA A6 LC-D HC-AB construct 7) enhanced PMN-mediated growth restriction compared to the PRASA A6 parental mAb (construct 4). The lack of enhancement in growth restriction by the CR5133/anti-LukD FN3 domain-mAbs (PRASA A6 LC-D construct 5) is consistent with previous findings that LukED production is minimal during ex vivo infection models.

As shown in FIG. 21, the FN3 domain variant Luk540 exhibits binding to the LukS-PV subunit of the PVL leukotoxin but does not neutralize the cytolytic activity of PVL. In contrast, Luk647 exhibits binding to the LukS-PV subunit of the PVL leukotoxin and neutralizes the cytolytic activity of the PVL leukotoxin as exemplified by complete inhibition of LDH release.

DETAILED DESCRIPTION

Figure 1A:
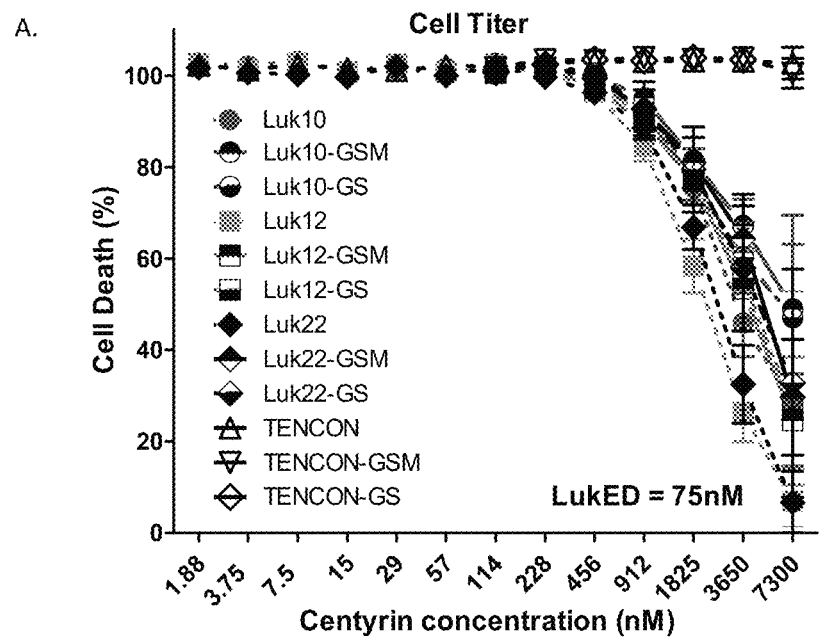
FIGS. 1A and 1B show the characterization of anti-LukD FN3 domains. LukED (75 nM) was mixed with increasing concentrations of the indicated FN3 domains for 30 minutes prior mixing with hPMNs. Cells were intoxicated for 1 hr. Data was generated from at least three independent blood donors, and error bars represent mean±SEM.
Figure 1B:
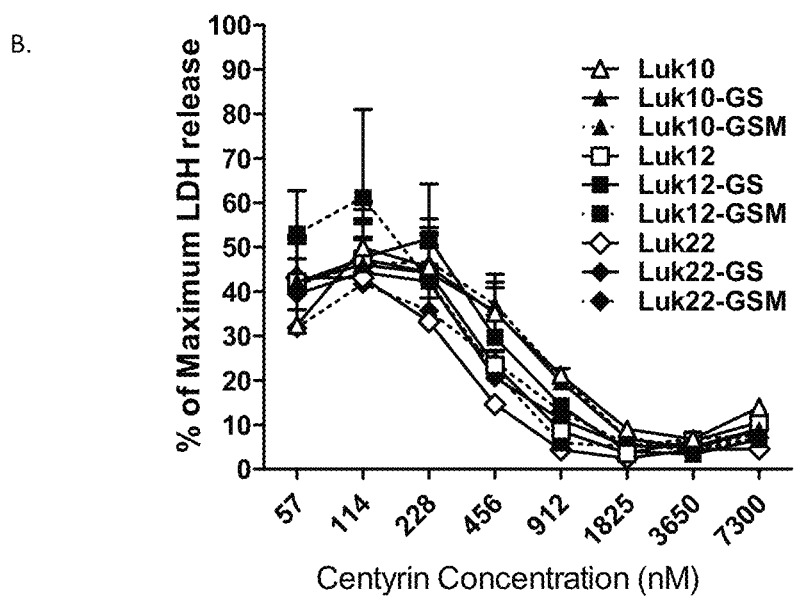

The present invention provides binding molecules comprising a first binding domain capable of binding to a glycosylated staphylococcal surface protein, and a second binding domain capable of binding to a staphylococcal leukotoxin. Accordingly, the binding molecules are at least bi-specific in that they are capable of specifically binding to at least two different *staphylococcus* virulence factors. Preferably, the binding molecules are human binding molecules.

In one embodiment, the first binding domain and the second binding domain of the binding molecule comprise an antibody (or fragment thereof), an alternative scaffold, or a combination thereof (e.g., the binding molecule comprises an antibody (or fragment thereof) and an alternative scaffold, each of which binds to a different bacterial virulence factor). Methods of producing these binding molecules are also provided.

Preferably, these multi-specific binding molecules exhibit bactericidal activity against staphylococci and, thus, can be used in the prevention, treatment, detection, diagnosis and/or amelioration of a *Staphylococcus* infection, including MRSA and MSSA infections.

Prior to disclosing the invention in detail the following definitions are provided. Unless defined otherwise, all technical and scientific terms used herein have the same meaning as commonly understood to one of ordinary skill in the art to which this invention belongs.

The term "binding molecule" in the sense of the present disclosure indicates any molecule capable of specifically binding to, interacting with, or recognizing two or more different antigens or targets. In this sense, the binding molecule of the invention is at least "bispecific," which term as used herein refers to a molecule that comprises at least a first binding domain that is capable of binding to one antigen or target, and a second binding domain that is capable of binding to another antigen or target. In particular, the binding molecule of the present invention is capable of binding to, interacting with and/or recognizing a staphylococcal leukotoxin and a glycosylated staphylococcal surface protein. The binding molecule of the invention also includes multispecific binding molecules that are capable of binding two or more antigens simultaneously, including, but not limited to, trispecific binding molecules having three binding domains, tetraspecific molecular having four binding domains, etc. Each binding domain of the multispecific binding molecules is capable of binding a different antigen or bacterial protein, e.g., different *staphylococcus* antigens or proteins.

According to the present invention, exemplary binding molecules are polypeptides. Such polypeptides may include proteinaceous parts and non-proteinaceous parts (e.g., chemical linkers or chemical cross-linking agents).

The term "binding domain" characterizes, in connection with the present disclosure, a domain of the binding molecule which is capable of specifically binding to/interacting with a given target epitope or a given target site on the target molecules, for example, a staphylococcal leukotoxin (e.g., LukAB, LukD and/or LukE) and/or a glycosylated staphylococcal surface protein (e.g., an SdgB-glycosylated staphylococcal SDR-containing protein).

Binding domains can be derived from a binding domain donor such as for example an antibody, protein A, ImmE7 (immunity proteins), BPTI/APPI (Kunitz domains), Ras-binding protein AF-6 (PDZ-domains), charybdotoxin (Scorpion toxin), CTLA-4, Min-23 (knottins), lipocalins (anticalins), neokarzinostatin, a fibronectin domain, an ankyrin consensus repeat domain or thioredoxin (Skerra, A., "Alternative Non-Antibody Scaffolds for Molecular Recognition," *Curr. Opin. Biotechnol.* 18:295-304 (2005); Hosse et al., "A New Generation of Protein Display Scaffolds for Molecular Recognition," *Protein Sci.* 15:14-27 (2006); Nicaise et al., "Affinity transfer by CDR grafting on a Nonimmunoglobulin Scaffold," *Protein Sci.* 13:1882-1891 (2004); Nygren and Uhlen, "Scaffolds for Engineering Novel Binding Sites in Proteins," *Curr. Opin. Struc. Biol.* 7:463-469 (1997), all of which are hereby incorporated by reference in their entirety)). It is envisioned that a binding domain of the present invention comprises at least said part of any of the aforementioned binding domains that is required for binding to/interacting with a given target epitope or a given target site on the target molecules.

It is envisaged that the binding domain of the aforementioned binding domain donors is characterized by that part of these donors that is responsible for binding the respective target, i.e., when that part is removed from the binding domain donor, said donor loses its binding capability. "Loses" means a reduction of at least 50% of the binding capability when compared with the binding donor. Methods to map these binding sites are well known in the art—it is therefore within the standard knowledge of the skilled person to locate/map the binding site of a binding domain donor and, thereby, to "derive" said binding domain from the respective binding domain donors.

The first and/or second binding domains of the binding molecule may comprise an immunoglobulin, for example an antibody, fragment thereof, or derivative thereof. The first and/or second binding domains of the binding molecule may alternatively comprise an alternative scaffold. In one embodiment, the binding molecule may comprise one or more immunoglobulin binding domains and one or more alternative scaffold binding domains.

As used herein, the term "alternative scaffold" refers to a single chain polypeptidic framework typically of reduced size (e.g., less than about 200 amino acids) that contains a highly structured core associated with variable domains of high conformational tolerance allowing insertions, deletions, or other substitutions. These scaffolds are based either on a conventional Ig backbone, or are derived from a completely unrelated protein. These variable domains can be modified to create novel binding interfaces toward any targeted protein. For example, such a scaffold can be derived from Protein A, in particular, the Z-domain thereof (affibodies), ImmE7 (immunity proteins), BPTI/APPI (Kunitz domains), Ras-binding protein AF-6 (PDZ-domains), charybdotoxin (Scorpion toxin), CTLA-4, Min-23 (knottins), lipocalins (anticalins), neokarzinostatin, a fibronectin domain, an ankyrin consensus repeat domain, or thioredoxin (Skerra, A., "Alternative Non-Antibody Scaffolds for Molecular Recognition," *Curr. Opin. Biotechnol.* 18:295-304 (2005); Hosse et al., "A New Generation of Protein Display Scaffolds for Molecular Recognition," *Protein Sci.* 15:14-27 (2006); Nicaise et al., "Affinity Transfer by CDR Grafting on a Nonimmunoglobulin Scaffold," *Protein Sci.* 13:1882-1891 (2004); Nygren and Uhlen, "Scaffolds for Engineering Novel Binding Sites in Proteins," *Curr. Opin. Struc. Biol.* 7:463-469 (1997), all of which are hereby incorporated by reference in their entirety). The structure of alternative scaffolds vary, but preferably are of human origin for those developed as therapeutics.

Non-Ig based scaffolds include, but are not limited to, lipocalins (used in "anticalins"), ankyrin repeat (AR) proteins (used in "designed AR proteins" or "DARPins"), fibronectin domain derivatives (used in "adnectin"), and avidity multimers (also known as "avimers").

Anticalins, an engineered protein scaffold comprising a lipocalin backbone, are a suitable non-Ig based alternative scaffolds for use in the binding molecules of the present invention. Lipocalins, a family of proteins that transport small hydrophobic molecules such as steroids, bilins, retinoids, and lipids, are the parental protein structure of anticalins. Lipocalins have limited sequence homology, but share a common tertiary structure architecture based on eight antiparallel b-barrels. These proteins contain four exposed loops built on the rigid beta-barrel structure. Exemplary lipocalins have a domain size of about 160 amino acids to about 180 amino acids and have been developed to contain randomization of 16 accessible amino acids within the four exposed loops.

Proteins comprising ankyrin repeat (AR) proteins are another suitable non-Ig based alternative scaffold for use in the binding molecules of the present invention. AR proteins comprise a 33 amino acid protein motif consisting of two alpha helices separated by loops, which repeats mediate protein-protein interactions. Designed Ankyrin Repeat Proteins (DARPins) comprise an engineered protein scaffold resulting from rational design strategies (e.g., multiple sequence alignments and statistical analysis) based on human AR proteins. DARPins can be generated using combinatorial AR libraries constructed based on the 33 amino acid AR motif with seven randomized positions. DARPin libraries are preferentially screened using ribosome display, and library members typically are well produced in *E. coli*, do not aggregate, and display high thermodynamic stability. Preferably, DARPins contain two to four of these motifs flanked by N- and C-terminal capping motifs to shield hydrophobic regions and allow increased solubility.

Proteins derived from fibronectin III (FN3) domains can also be used to generate a suitable non-Ig based alternative scaffold. For example, the tenth fibronectin type III domain (FN10) of human fibronectin corresponds to a beta-sandwich with seven beta-strands and three connecting loops showing structural homologies to Ig domains without disulfide bridges. In one aspect, the connecting loops of FN10, each about 15 to 21 amino acids in length, can be randomized and the domains displayed on both phage and yeast to select for a scaffold with the desirable properties. Adnectin (Adnexus, now Bristol-Myers-Squibb) is an exemplary scaffold generated using $10^{th}$ FN3 domains randomized and displayed in this way. An alternative exemplary scaffold comprising FN3 domains is a Centyrin™. Centyrins™ contain the consensus sequence of FN3 domains of human Tenascin C (TNC). Centyrin™ scaffolds have loops (i.e., DE, BC and FG) that have structural homology to antibody variable domains (i.e., CDR1, CDR2 and CDR3), and are small (about 10 kDa), simple, and highly stable single domain proteins that do not contain cysteine, disulfides or glycosylated residues. These molecules have excellent biophysical properties (e.g., greater than 100 mg/mL expression, greater than 170 mg/mL solubility, greater than 82° C. melting temperature, low predicted immunogenicity, and stable in serum for more than one month), and can be engineered for improved stability. Therefore, Centyrins™ are a suitable alternative scaffold derived from FN domains for use in the present binding molecules.

In one embodiment, the binding molecule as described herein comprises a Centyrin™ or FN3 domain that comprises an amino acid sequence of any one of SEQ ID NOs:14-59 or SEQ ID NOs:113-666. Exemplary FN3 domain sequences of the binding molecule described herein include Luk17 and Luk12 (SEQ ID NO:14 and SEQ ID NO:22, respectively).

The avimer structure can also be used as a protein backbone to generate a suitable non-Ig based alternative scaffold. The avimer scaffold is based on oligomerization of A-domains from low-density lipoprotein (LRL) cell surface receptors. Preferably, the avimer scaffold comprises universally conserved residues of the A-domain, which is about 35 amino acids in length and comprises four loops with three disulfide bridges.

Additionally, the present invention also contemplates binding molecules comprising an Ig-like scaffold selected from, e.g., a nanobody, a domain antibody (dAb), a bispecific T cell engager (BiTE), a dual affinity retargeting protein (DART), and a Tetravalent tANDem AntiBodies (TandAb) (see, e.g., Wurch et al., "Novel Protein Scaffolds as Emerging Therapeutic Proteins: From Discovery to Clinical Proof-of-Concept," *Trends in Biotechnology* 30(11):575-582 (2012), which is hereby incorporated by reference in its entirety).

The binding molecule can also be a fusion protein comprising an antibody, fragment thereof, or derivative linked to an alternative scaffold. In one embodiment, binding molecules comprise an antibody, a fibronectin domain or an antibody-fibronectin domain fusion protein. For example, in one aspect, the binding molecule of the present invention comprises a full-length antibody or antibody fragment that is capable of binding to a glycosylated staphylococcal surface protein, such as a SdgB-glycosylated SDR-containing protein, and further comprises an alternative scaffold that is capable of binding to a staphylococcal leukotoxin, such as LukAB, LukD, or LukE. It is understood that clinical isolates of Staph may have varying sequences among different strains. Therefore, in one aspect, the alternative scaffold comprises a FN3 domain that is capable of binding to LukA having an amino acid sequence with 80%, 90%, 95%, 97%, 98% or 99% sequence identity to SEQ ID NO:10, LukB having an amino acid sequence with 80%, 90%, 95%, 97%, 98% or 99% sequence identity to SEQ ID NO:11, LukD having an amino acid sequence with 80%, 90%, 95%, 97%, 98% or 99% sequence identity to SEQ ID NO:12, or LukE having an amino acid sequence with 80%, 90%, 95%, 97%, 98% or 99% sequence identity to SEQ ID NO:13. In one aspect, the alternative scaffold of the binding molecule comprises a FN3 domain that is capable of binding to LukA having the amino acid sequence of SEQ ID NO:10, LukB having the amino acid sequence of SEQ ID NO:11, LukD having the amino acid sequence of SEQ ID NO:12, or LukE having the amino acid sequence of SEQ ID NO:13. In another aspect, the alternative scaffold of the binding molecule comprises a FN3 domain that is capable of binding a LukAB complex comprising LukA having the amino acid sequence of SEQ ID NO:10 and LukB having the amino acid sequence of SEQ ID NO:11. In another aspect, the alternative scaffold of the binding molecule comprises a FN3 domain that is capable of binding a LukED complex comprising LukD having the amino acid sequence of SEQ ID NO:12, and LukE having the amino acid sequence of SEQ ID NO:13.

It is envisaged that the binding molecule is produced by (or obtainable by) phage-display or library screening methods. Alternatively, the binding molecule is produced by grafting CDR sequences from a pre-existing (monoclonal) antibody into a scaffold, for example, a scaffold as disclosed herein.

The terms "capable of binding to", "binding to", "specifically recognizing", "directed to" and "reacting with" mean, in accordance with this invention, that a binding domain is capable of specifically interacting with one or more amino acids of an epitope.

The term "is not capable of specific binding" means that a binding domain of the present invention does not bind another protein or antigen, e.g., a non-target protein, under the conditions tested. For example, in the present disclosure, Protein A binding was measured using plate-based direct ELISA assays under the conditions specified in the Examples, which detected no appreciable binding to Protein A for binding molecules containing the CH3 mutations H435R/Y436F (e.g., constructs 3-7). However, if the same experiments were performed with a 100-1000-fold excess of protein, some Protein A binding (non-specific) may be detected. This general principle also applies to human FcγRI binding (or lack thereof) and Sbi binding (or lack thereof) under the conditions provided herein.

"Proteins" (including fragments thereof, preferably biologically active fragments, and peptides, usually having less than 30 amino acids) comprise one or more amino acids coupled to each other via a covalent peptide bond (resulting in a chain of amino acids). The term "polypeptide" as used herein is a chain of more than 30 amino acids coupled together. Polypeptides may form multimers such as dimers, trimers and higher oligomers, i.e., consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a heteromultimer is an antibody molecule, which, in its naturally occurring form, consists of two identical light polypeptide chains and two identical heavy polypeptide chains.

The terms "polypeptide" and "protein" also refer to naturally modified polypeptides/proteins wherein the modification is effected e.g., by post-translational modifications like glycosylation, acetylation, phosphorylation and the like. A "polypeptide" when referred to herein may also be chemically modified such as pegylated. Such modifications are well known in the art.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (Ile or I): leucine (Leu or L); lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, Ile, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gln, Gly, His, Met, Phe, Ser, Thr, Trp, and Tyr).

The term "virulence factor" as used herein refers to a molecule expressed by bacteria that enables the bacteria to achieve colonization of a niche in the host (including adhesion to cells), immunoevasion (i.e., evasion of the host's immune response), immunosuppression (i e, inhibition of the host's immune response), entry into and exit out of cells (if the pathogen is an intracellular one), and/or obtain nutrition from the host. The virulence factors may be encoded on mobile genetic elements, such as bacteriophages, and can easily be spread through horizontal gene transfer. Non-limiting examples of *Staphylococcus aureus* virulence factors include hyaluronidase, protease, coagulase, lipases, deoxyribonucleases, enterotoxins and other toxins, e.g., toxins that act on cell membranes such as LukAB, LukD or LukE. For the purposes of this invention, staphylococcal surface proteins, such as SDR-containing proteins, e.g., ClfA, ClfB, SdrC, SdrD, SdrE, SdrF, SdrG and SdrH, are also considered to be a virulence factors.

The definition of the term "antibody" includes embodiments such as monoclonal, chimeric, single chain, humanized and human antibodies. In addition to full-length antibodies, the definition also includes antibody derivatives and antibody fragments, like, inter alia, Fab fragments. Antibody fragments or derivatives further comprise $F(ab')_2$, Fv, scFv fragments or single domain antibodies such as domain antibodies or nanobodies, single variable domain antibodies or immunoglobulin single variable domains comprising merely one variable domain, which might be VHH, VH or VL, that specifically bind an antigen or epitope independently of other V regions or domains; see, for example, Harlow and Lane, Antibodies: A Laboratory Manual, Cold Spring harbor Press (1988); Harlow and Lane, Using Antibodies: A Laboratory Manual, Cold Spring Harbor Press (1999); Kontermann and Dübel, ANTIBODY ENGINEERING, Springer, 2nd ed. 2010; and Little, RECOMBINANT ANTIBODIES FOR IMMUNOTHERAPY, Cambridge University Press 2009, each of which is hereby incorporated by reference in its entirety. Said term also includes diabodies or Dual-Affinity Re-Targeting (DART) antibodies. Further envisaged are (bispecific) single chain diabody, tandem diabody (Tandab), "minibodies" exemplified by a structure which is as follows: $(VH-VL-CH3)_2$, $(scFv-CH3)_2$ or $(scFv-CH3-scFv)_2$, "Fc DART" and "IgG DART", multibodies such as triabodies.

Immunoglobulin single variable domains encompass not only an isolated antibody single variable domain polypeptide, but also larger polypeptides that comprise one or more monomers of an antibody single variable domain polypeptide sequence.

Various procedures are known in the art and may be used for the production of such antibodies and/or fragments. Thus, (antibody) derivatives can be produced by peptidomimetics. Further, techniques described for the production of single chain antibodies (see, inter alia, U.S. Pat. No. 4,946,778 to Ladner et al., Kontermann and Dübel, ANTIBODY ENGINEERING, Springer, $2^{nd}$ ed. 2010, and Little, RECOMBINANT ANTIBODIES FOR IMMUNOTHERAPY, Cambridge University Press, 2009, each of which is hereby incorporated by reference in its entirety) can be adapted to produce single chain antibodies specific for elected polypeptide(s). Also, transgenic animals may be used to express humanized antibodies specific for polypeptides and fusion proteins of this invention. For the preparation of monoclonal antibodies, any technique, providing antibodies produced by continuous cell line cultures can be used. Examples for such techniques include the hybridoma technique (Köhler and Milstein, "Continuous Cultures of Fused Cells Secreting Antibody of Predefined Specificity," Nature 256: 495-497 (1975), which is hereby incorporated by reference in its entirety), the trioma technique, the human B cell hybridoma technique (Kozbor et al., "The Production of Monoclonal Antibodies From Human Lymphocytes," Immunology Today 4:72-79 (1983), which is hereby incorporated by reference in its entirety) and the EBV hybridoma technique to produce human monoclonal antibodies (Cole et al., in MONOCLONAL ANTIBODIES AND CANCER THERAPY, Alan R. Liss, Inc., pp. 77-96 (1985), which is hereby incorporated by reference in its entirety). Surface plasmon resonance as employed in the BIAcore system can be used to increase the efficiency of phage antibodies which bind to an epitope of a target polypeptide, such as CD3 epsilon (Schier et al., "Efficient In Vitro Affinity Maturation of Phage Antibodies Using BIAcore Guided Selections," Human Antibodies Hybridomas 7:97-105 (1996); Malmborg et al., "BIAcore as a Tool in Antibody Engineering," J. Immunol. Methods 183:7-13 (1995), each of which is hereby incorporated by reference in its entirety). It is also envisaged in the context of this invention that the term "antibody" comprises antibody constructs, which may be expressed in a host as described herein below, e.g., antibody constructs which may be transfected and/or transduced via, inter alia, viruses or plasmid vectors.

Furthermore, the term "antibody" as employed herein also relates to derivatives or variants of the antibodies described herein which display the same specificity as the described antibodies. Examples of "antibody variants" include humanized variants of non-human antibodies, "affinity matured" antibodies (see e.g., Hawkins et al., "Selection of Phage Antibodies by Binding Affinity. Mimicking Affinity Maturation," J. Mol. Biol. 254:889-896 (1992) and Lowman et al., "Selecting High-Affinity Binding Proteins by Monovalent Phage Display," Biochemistry 30:10832-10837 (1991), each of which is hereby incorporated by reference in its entirety) and antibody mutants with altered effector function (s) (see, e.g., U.S. Pat. No. 5,648,260 to Winter et al., Kontermann and Dübel, ANTIBODY ENGINEERING, Springer, $2^{nd}$ ed. 2010, and Little, RECOMBINANT ANTIBODIES FOR IMMUNOTHERAPY, Cambridge University Press, 2009, each of which is hereby incorporated by reference in its entirety).

One exemplary method of making antibodies includes screening protein expression libraries, e.g., phage or ribosome display libraries. Phage display is described, for example, in U.S. Pat. No. 5,223,409 to Ladner et al.; Smith, "Filamentous Fusion Phage: Novel Expression Vectors That Display Cloned Antigens on the Virion Surface," Science 228:1315-1317 (1985); Clackson et al., "Making Antibody Fragments Using Phage Display Libraries," Nature 352: 624-628 (1991), each of which is hereby incorporated by reference in its entirety.

In addition to the use of display libraries, the specified antigen can be used to immunize a non-human animal, e.g., a rodent, a mouse, hamster, or rat. For example, it is possible to engineer mouse strains deficient in mouse antibody production with large fragments of the human Ig loci. Using the hybridoma technology, antigen-specific monoclonal antibodies derived from the genes with the desired specificity may be produced and selected. See, e.g., XENOMOUSE™, Green et al., "Antigen-Specific Human Monoclonal Antibodies From Mice Engineered With Human Ig Heavy and Light Chain YACs," Nature Genetics 7:13-21 (2004), US 2003-0070185 to Jakobovits et al., WO96/34096 to Kucherlapati et al., and WO96/33735 to Kucherlapati et al., each of which is hereby incorporated by reference in its entirety.

An antibody or fragment thereof may also be modified by specific deletion of human T cell epitopes or "deimmunization" by the methods disclosed in WO98/52976 to Carr et al. and WO00/34317 to Can et al., which are hereby incorporated by reference in their entirety. Briefly, the heavy and light chain variable domains of an antibody can be analyzed for peptides that bind to MHC class II; these peptides represent potential T cell epitopes (as defined in WO98/52976 to Can et al. and WO00/34317 to Can et al., both of which are hereby incorporated by reference in their entirety). For detection of potential T cell epitopes, a computer modeling approach termed "peptide threading" can be applied, and in addition a database of human MHC class II binding peptides can be searched for motifs present in the VH and VL sequences, as described in WO98/52976 to Can et al. and WO00/34317 to Can et al., both of which are hereby incorporated by reference in their entirety. These motifs bind to any of the 18 major MHC class II DR allotypes, and thus constitute potential T cell epitopes. Potential T-cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences, e.g., are disclosed in Tomlinson et al., "The Repertoire of Human Germline VH Sequences Reveals About Fifty Groups of VH Segments With Different Hypervariable Loops," J. Mol. Biol. 227:776-798 (1992); Cook et al., "The Human Immunoglobulin VH Repertoire," Immunol. Today 16 (5):237-242 (1995); and Tomlinson et al., "The Structural Repertoire of the Human V Kappa Domain," EMBO J. 14:14:4628-4638 (1995), each of which is hereby incorporated by reference in its entirety. The V BASE directory provides a comprehensive directory of human immunoglobulin variable region sequences (compiled by Tomlinson, L A. et al. MRC Centre for Protein Engineering, Cambridge, UK). These sequences can be used as a source of human sequence, e.g., for framework regions and CDRs. Consensus human framework regions can also be used, e.g., as described in U.S. Pat. No. 6,300,064 to Knappik et al., which is hereby incorporated by reference in its entirety. The pairing of a VH and VL together forms a single antigen-binding site. The constant heavy (CH) domain most proximal to VH is designated as CH1. Each L chain is linked to an H chain by one covalent disulfide bond, while the two H chains are linked to each other by one or more disulfide bonds depending on the H chain isotype. The VH and VL domains consist of four regions of relatively conserved sequences called framework regions (FR1, FR2, FR3, and FR4), which form a scaffold for three regions of hypervariable sequences (complementarity determining regions, CDRs). The CDRs contain most of the residues responsible for specific interactions of the antibody with the antigen. CDRs are referred to as CDR1, CDR2, and CDR3. Accordingly, CDR constituents on the heavy chain are referred to as H1, H2, and H3, while CDR constituents on the light chain are referred to as L1, L2, and L3.

The term "variable" refers to the portions of the immunoglobulin domains that exhibit variability in their sequence and that are involved in determining the specificity and binding affinity of a particular antibody (i.e., the "variable domain(s)" or "V-region"). Variability is not evenly distributed throughout the variable domains of antibodies; it is concentrated in sub-domains of each of the heavy and light chain variable regions.

These sub-domains are called "hypervariable" regions or "complementarity determining regions" (CDRs). The more conserved (i.e., non-hypervariable) portions of the variable domains are called the "framework" regions (FRM). The variable domains of naturally occurring heavy and light chains each comprise four FRM regions, largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding site (see Wu and Kabat, "An Analysis of the Sequences of the Variable Regions of Bence Jones Proteins and Myeloma Light Chains and their Implications for Antibody Complementarity," *J. Exp. Med.* 132:211-250 (1970), which is hereby incorporated by reference in its entirety). The constant domains are not directly involved in antigen binding, but exhibit various effector functions, such as, for example, antibody-dependent, cellular cytotoxicity and complement activation.

The term "hypervariable region" (also known as "complementarity determining regions" or CDRs) when used herein refers to the amino acid residues of an antibody which are (usually three or four short regions of extreme sequence variability) within the V-region domain of an immunoglobulin which form the antigen-binding site and are the main determinants of antigen specificity. There are at least two methods for identifying the CDR residues: (1) An approach based on cross-species sequence variability (Kabat et al., *Sequences of Proteins of Immunological Interest*, 5th ed. NIH Publication No. 91-3242 (1991), which is hereby incorporated by reference in its entirety); and (2) An approach based on crystallographic studies of antigen-antibody complexes (Chothia et al., "Canonical Structures For the Hypervariable Regions of Immunoglobulins," *J. Mol. Biol.* 196:901-917 (1987), which is hereby incorporated by reference in its entirety). However, to the extent that two residue identification techniques define regions of overlapping, but not identical regions, they can be combined to define a hybrid CDR. However, in general, the CDR residues are preferably identified in accordance with the Kabat (numbering) system.

The terms "antigen-binding domain", "antigen-binding fragment" and "antibody binding region" when used herein refer to a part of an antibody molecule that comprises amino acids responsible for the specific binding between antibody and antigen. The part of the antigen that is specifically recognized and bound by the antibody is referred to as the "epitope" as described herein above. As mentioned above, an antigen-binding domain may typically comprise an antibody light chain variable region (VL) and an antibody heavy chain variable region (VH); however, it does not have to comprise both. Fd fragments, for example, have two VH regions and often retain some antigen-binding function of the intact antigen-binding domain. Examples of antigen-binding fragments of an antibody include (1) a Fab fragment, a monovalent fragment having the VL, VH, constant light (CL) and CH1 domains; (2) a F(ab')$_2$ fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., "Binding Activities of a Repertoire of Single Immunoglobulin Variable Domains Secreted From *Escherichia coli,*" *Nature* 341:544-546 (1989), which is hereby incorporated by reference) which has a VH domain; (6) an isolated complementarity determining region (CDR), and (7) a single chain Fv (scFv), for example, derived from a scFV-library. Although the two domains of the Fv fragment, VL and VH are coded for by separate genes, they can be joined, using recombinant methods, by a synthetic linker that enables them to be made as a single protein chain in which the VL and VH regions pair to form monovalent molecules (known as single chain Fv (scFv) (see e.g., Huston et al., "Protein Engineering of Antibody Binding Sites: Recovery of Specific Activity in an Anti-Digoxin Single-Chain Fv Analogue Produced in *Escherichia coli,*" *Proc. Natl. Acad. Sci. USA* 85:5879-5883 (1988), which is hereby incorporated by reference in its entirety). These antibody fragments are obtained using conventional techniques known to those with skill in the art, and the fragments are evaluated for function in the same manner as are intact antibodies.

The term "monoclonal antibody" as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site. Furthermore, in contrast to conventional (polyclonal) antibody preparations which typically include different antibodies directed against different determinants (epitopes), each monoclonal antibody is directed against a single determinant on the antigen. In addition to their specificity, the monoclonal antibodies are advantageous in that they are synthesized by the hybridoma culture, uncontaminated by other immunoglobulins.

The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler et al., "Continuous Cultures of Fused Cells Secreting Antibody of Predefined Specificity," *Nature* 256:495 (1975), or may be made by recombinant DNA methods (see, e.g., U.S. Pat. No. 4,816,567 to Cabilly et al.), each of which is hereby incorporated by reference in its entirety.

The "monoclonal antibodies" may also be isolated from phage antibody libraries using the techniques described in Clackson et al., "Making Antibody Fragments Using Phage Display Libraries," *Nature* 352:624-628 (1991) and Marks et al., "By-Passing Immunization. Human Antibodies From V-gene Libraries Displayed on Phage," *J. Mol. Biol.* 222: 581-597 (1991), for example, each of which is hereby incorporated by reference in its entirety.

The monoclonal antibodies of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is (are) identical with or homologous to corresponding sequences in antibodies derived from another species or belonging to another antibody class or subclass, as well as fragments of such antibodies, so long as they exhibit the desired biological activity (U.S. Pat. No. 4,816, 567 to Cabilly et al.; Morrison et al., "Chimeric Human Antibody Molecules: Mouse Antigen-Binding Domains With Human Constant Region Domains," *Proc. Natl. Acad. Sci. USA* 81:6851-6855 (1984), both of which are hereby incorporated by reference in their entirety). Chimeric antibodies of interest herein include "primitized" antibodies comprising variable domain antigen-binding sequences derived from a non-human primate (e.g., Old World Monkey, Ape etc.) and human constant region sequences.

A monoclonal antibody can be obtained from a non-human animal, and then modified, e.g., humanized, deimmunized, chimeric, may be produced using recombinant DNA techniques known in the art. A variety of approaches for making chimeric antibodies have been described. See e.g., Morrison et al., "Chimeric Human Antibody Molecules: Mouse Antigen-Binding Domains With Human Constant Region Domains," *Proc. Natl. Acad. Sci. U.S.A.* 81:6851 (1985); Takeda et al., "Construction of Chimeric Processed Immunoglobulin Genes Containing Mouse Variable and Human Constant Region Sequences," *Nature* 314: 452 (1985); U.S. Pat. No. 4,816,567 to Cabilly et al.; U.S. Pat. No. 4,816,397 to Boss et al.; EP 0171496 to Tanaguchi et al.; EP 0173494 to Morrison et al., *GB* 2177096 to Neuberger et al., each of which are hereby incorporated by reference in their entirety.

"Humanized" forms of non-human (e.g., murine) antibodies are chimeric immunoglobulins, immunoglobulin chains or fragments thereof (such as Fv, Fab, Fab', F(ab')$_2$ or other antigen-binding subsequences of antibodies) of mostly human sequences, which contain minimal sequence derived from non-human immunoglobulin. For the most part, humanized antibodies are human immunoglobulins (recipient antibody) in which residues from a hypervariable region (also CDR) of the recipient are replaced by residues from a hypervariable region of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody optimally also will comprise at least a portion of an immunoglobulin constant region (Fc), typically that of a human immunoglobulin. For further details, see Jones et al., "Replacing the Complementarity-Determining Regions in a Human Antibody With Those From a Mouse," *Nature* 321:522-525 (1986) and Reichmann et al., "Reshaping Human Antibodies for Therapy," *Nature* 332:323-329 (1988) each of which is hereby incorporated by reference in its entirety.

Humanized antibodies may also be produced, for example, using transgenic mice that express human heavy and light chain genes, but are incapable of expressing the endogenous mouse immunoglobulin heavy and light chain genes. Winter describes an exemplary CDR-grafting method that may be used to prepare the humanized antibodies described herein (U.S. Pat. No. 5,225,539 to Winter et al., which is hereby incorporated by reference in its entirety). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

Humanized antibodies or fragments thereof can, for example, be generated by replacing sequences of the Fv variable domain that are not directly involved in antigen binding with equivalent sequences from human Fv variable domains. Exemplary methods for generating humanized antibodies or fragments thereof are provided by Morrison, S L., "Transfectomas Provide Novel Chimeric Antibodies," *Science* 229:1202-1207 (1985); by U.S. Pat. No. 5,585,089 to Queen et al.; U.S. Pat. No. 5,693,761 to Queen et al.; U.S. Pat. No. 5,693,762 to Queen et al.; U.S. Pat. No. 5,859,205 to Adair et al.; and U.S. Pat. No. 6,407,213 to Carter et al., each of which is hereby incorporated by reference in its entirety. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector.

A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., "Construction and Testing of Mouse—Human Heteromyelomas for Human Monoclonal Antibody Production," *Proc. Natl. Acad. Sci. U.S.A.* 80:7308-7312 (1983); Kozbor et al., "The Production of Monoclonal Antibodies from Human Lymphocytes," *Immunology Today* 4:72-79 (1983); Olsson et al., "Human—Human Monoclonal Antibody-Producing Hybridomas: Technical Aspects," *Meth. Enzymol.* 92:3-16 (1982), each of which is hereby incorporated by reference in its entirety), and may be made according to the teachings of EP239400 to Winter, which is hereby incorporated by reference in its entirety.

The term "human antibody" includes antibodies having variable and constant regions corresponding substantially to human germline immunoglobulin sequences known in the art, including, for example, those described by Kabat et al., *Sequences of Proteins of Immunological Interest,* 5th ed. NIH Publication No. 91-3242 (1991), which is hereby incorporated by reference in its entirety. The human antibodies of the invention may include amino acid residues not encoded by human germline immunoglobulin sequences (e.g., mutations introduced by random or site-specific mutagenesis in vitro or by somatic mutation in vivo), for example in the CDRs, and in particular, CDR3. The human antibody can have at least one, two, three, four, five, or more positions replaced with an amino acid residue that is not encoded by the human germline immunoglobulin sequence.

A "bispecific" or "bifunctional" antibody or immunoglobulin is an artificial hybrid antibody or immunoglobulin having two different heavy/light chain pairs and two different binding sites. Bispecific antibodies can be produced by a variety of methods including fusion of hybridomas or linking of Fab' fragments (see e.g., Songsivilai & Lachmann, "Bispecific Antibody: A Tool for Diagnosis and Treatment of Disease," Clin. Exp. Immunol. 79:315-321 (1990), which is hereby incorporated by reference in its entirety). Numerous methods known to those skilled in the art are available for obtaining antibodies or antigen-binding fragments thereof. For example, antibodies can be produced using recombinant DNA methods (U.S. Pat. No. 4,816,567 to Cabilly, which is hereby incorporated by reference in its entirety). Monoclonal antibodies may also be produced by generation of hybridomas (see e.g., Kohler et al., "Continuous Cultures of Fused Cells Secreting Antibody of Predefined Specificity," Nature 256:495 (1975), which is hereby incorporated by reference in its entirety) in accordance with known methods. Hybridomas formed in this manner are then screened using standard methods, such as enzyme-linked immunosorbent assay (ELISA) and surface plasmon resonance (BIA-CORE™) analysis, to identify one or more hybridomas that produce an antibody that specifically binds with a specified antigen. Any form of the specified antigen may be used as the immunogen, e.g., recombinant antigen, naturally occurring forms, any variants or fragments thereof, as well as antigenic peptide thereof.

The terms "CDR", and its plural "CDRs", refer to a complementarity determining region (CDR) of which three make up the binding character of a light chain variable region (CDRL1, CDRL2 and CDRL3) and three make up the binding character of a heavy chain variable region (CDRH1, CDRH2 and CDRH3). CDRs contribute to the functional activity of an antibody molecule and are separated by amino acid sequences that comprise scaffolding or framework regions. The exact definitional CDR boundaries and lengths are subject to different classification and numbering systems. CDRs may therefore be referred to by Kabat, Chothia, contact or any other boundary definitions. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat et al., Sequences of Proteins of Immunological Interest, 5th ed. NIH Publication No. 91-3242 (1991); Chothia et al., "Canonical Structures For the Hypervariable Regions of Immunoglobulins," J. Mol. Biol. 196:901 (1987); and MacCallum et al., "Antibody-Antigen Interactions: Contact Analysis and Binding Site Topography," J. Mol. Biol. 262:732 (1996)), each of which is hereby incorporated by reference in its entirety.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia et al., "Canonical Structures For the Hypervariable Regions of Immunoglobulins," J. Mol. Biol. 196: 901 (1987); Chothia et al., "Conformations of Immunoglobulin Hypervariable Regions," Nature 342:877 (1989); Martin and Thornton, "Structural Families in Loops of Homologous Proteins: Automatic Classification, Modelling and Application to Antibodies," J. Mol. Biol. 263:800 (1996), each of which is incorporated by reference in its entirety). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat et al., Sequences of Proteins of Immunological Interest, 5th ed. NIH Publication No. 91-3242 (1991), which is hereby incorporated by reference in its entirety. The Kabat numbering scheme (system) is a widely adopted standard for numbering the amino acid residues of an antibody variable domain in a consistent manner and is the preferred scheme applied in the present invention as also mentioned elsewhere herein.

Additional structural considerations can also be used to determine the canonical structure of an antibody. For example, those differences not fully reflected by Kabat numbering can be described by the numbering system of Chothia et al and/or revealed by other techniques, for example, crystallography and two or three-dimensional computational modeling.

Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., "Canonical Structures For the Hypervariable Regions of Immunoglobulins," J. Mol. Biol. 196:901 (1987), which is hereby incorporated by reference in its entirety, and their implications for construing canonical aspects of antibody structure, are described in the literature.

CDR3 is typically the greatest source of molecular diversity within the antibody-binding site. H3, for example, can be as short as two amino acid residues or greater than 26 amino acids. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988, which is hereby incorporated by reference in its entirety. One of skill in the art will recognize that each subunit structure, e.g., a CH, VH, CL, VL, CDR, FR structure, comprises active fragments, e.g., the portion of the VH, VL, or CDR subunit the binds to the antigen, i.e., the antigen-binding fragment, or, e.g., the portion of the CH subunit that binds to and/or activates, e.g., an Fc receptor and/or complement. The CDRs typically refer to the Kabat CDRs, as described in Sequences of Proteins of immunological Interest, US Department of Health and Human Services (1991), eds. Kabat et al., which is hereby incorporated by reference in its entirety.

Another standard for characterizing the antigen binding site is to refer to the hypervariable loops as described by Chothia (see e.g., Chothia et al., "Structural Repertoire of the Human VH Segments," J. Mol. Biol. 227:799-817 (1987); and Tomlinson et al., "The Structural Repertoire of the Human V Kappa Domain," EMBO J. 14: 4628-4638

(1995), each of which is hereby incorporated by reference in its entirety). Still another standard is the AbM definition used by Oxford Molecular's AbM antibody modeling software. See, generally, e.g., Protein Sequence and Structure Analysis of Antibody Variable Domains. In: Antibody Engineering Lab Manual, Duebel and Kontermann (eds.), Springer-Verlag, which is hereby incorporated by reference in its entirety). Embodiments described with respect to Kabat CDRs can alternatively be implemented using similar described relationships with respect to Chothia hypervariable loops or to the AbM-defined loops. The sequence of antibody genes after assembly and somatic mutation is highly varied, and these varied genes are estimated to encode $10^{10}$ different antibody molecules (Immunoglobulin Genes, $2^{nd}$ ed., eds. Jonio et al., Academic Press, 1995, which is hereby incorporated by reference in its entirety). Accordingly, the immune system provides a repertoire of immunoglobulins.

The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332 to Hoogenboom et al., which is hereby incorporated by reference in its entirety. A repertoire may include only one sequence or may include a plurality of sequences, including ones in a genetically diverse collection.

The term "framework region" refers to the art-recognized portions of an antibody variable region that exist between the more divergent (i.e., hypervariable) CDRs. Such framework regions are typically referred to as frameworks 1 through 4 (FR1, FR2, FR3, and FR4) and provide a scaffold for the presentation of the six CDRs (three from the heavy chain and three from the light chain) in three dimensional space, to form an antigen-binding surface.

The term "fibronectin type III (FN3) domain" (FN3 domain) as used herein refers to a domain occurring frequently in proteins including fibronectins, tenascin, intracellular cytoskeletal proteins, cytokine receptors and prokaryotic enzymes (Bork and Doolittle, "Proposed Acquisition of an Animal Protein Domain by Bacteria," *Proc. Nat. Acad. Sci. USA* 89:8990-8994 (1992); Meinke et al., "Cellulose-Binding Polypeptides From Cellulomonas fimi: Endoglucanase D (CenD), a Family A beta-1,4-Glucanase," *J. Bacteriol.* 175:1910-1918 (1993); Watanabe et al., "Gene Cloning of Chitinase A1 From *Bacillus circulans* WL-12 Revealed its Evolutionary Relationship to *Serratia* chitinase and to the Type III Homology Units of Fibronectin," *J. Biol. Chem.* 265:15659-15665 (1990), each of which is hereby incorporated by reference in its entirety). Exemplary FN3 domains are the 15 different FN3 domains present in human tenascin C, the 15 different FN3 domains present in human fibronectin (FN), and non-natural synthetic FN3 domains as described for example in U.S. Pat. Publ. No. 2010/0216708 to Jacobs et al., which is hereby incorporated by reference in its entirety. Individual FN3 domains are referred to by domain number and protein name, e.g., the $3^{rd}$ FN3 domain of tenascin (TN3), or the $10^{th}$ FN3 domain of fibronectin (FN10).

The term "substituting" or "substituted" or "mutating" or "mutated" as used herein refers to altering, deleting of inserting one or more amino acids or nucleotides in a polypeptide or polynucleotide sequence to generate a variant of that sequence.

The term "randomizing" or "randomized" or "diversified" or "diversifying" as used herein refers to making at least one substitution, insertion or deletion in a polynucleotide or polypeptide sequence.

"Tencon" as used herein refers to the synthetic fibronectin type III (FN3) domain having the sequence shown in SEQ ID NO:1 and described in U.S. Pat. Publ. No. US2010/0216708 to Jacobs et al., which is hereby incorporated by reference in its entirety.

The term "library" refers to a collection of variants. The library may be composed of polypeptide or polynucleotide variants.

The term "vector" means a polynucleotide capable of being duplicated within a biological system or that can be moved between such systems. Vector polynucleotides typically contain elements, such as origins of replication, polyadenylation signal or selection markers that function to facilitate the duplication or maintenance of these polynucleotides in a biological system. Examples of such biological systems may include a cell, virus, animal, plant, and reconstituted biological systems utilizing biological components capable of duplicating a vector. The polynucleotide comprising a vector may be DNA or RNA molecules or a hybrid of these.

A vector can be utilized in a biological system or in a reconstituted biological system to direct the translation of a polypeptide encoded by a polynucleotide sequence present in the vector. Thus, a "vector," as used herein, refers broadly to any recombinant expression system for the purpose of expressing a nucleic acid sequence of the invention in vitro or in vivo, constitutively or inducibly, in any cell, including prokaryotic, yeast, fungal, plant, insect or mammalian cell. The term includes linear or circular expression systems. The term includes expression systems that remain episomal or integrate into the host cell genome. The expression systems can have the ability to self-replicate or not, i.e., drive only transient expression in a cell. The term includes recombinant expression cassettes which contain only the minimum elements needed for transcription of the recombinant nucleic acid.

The present application generally relates to multi-specific binding molecules that bind to at least two different bacterial virulence factors, methods for producing these binding molecules, and the use of these binding molecules to detect or diagnose, prevent and/or treat bacterial infections. In particular, the binding molecules comprise at least two binding domains, for example, an antibody or antibody fragment and an alternative scaffold. The first binding domain is capable of binding to a glycosylated staphylococcal surface protein, preferably an SdgB glycosylated SDR-containing protein. The second binding domain is capable of binding to a staphylococcal leukotoxin, preferably LukAB, LukD or LukE. These multi-specific binding molecules have neutralizing activity against the protein antigen they bind, i.e., once the binding molecule binds to its target staphylococcal proteins, the activity of those proteins is substantially, or completely eliminated. Accordingly, the multi-specific binding molecules also have neutralizing or bactericidal activity against *staphylococcus* itself, and, thus, can be used in the treatment and/or amelioration of a *Staphylococcus* infection, including methicillin-resistant and methicillin-sensitive *Staphylococcus aureus*.

The binding molecules hereof may also be capable of specifically binding to one or more fragments of staphylococci (and other gram-positive and/or gram-negative bacteria) such as, inter alia, a preparation of one or more proteins and/or (poly)peptides derived from staphylococci or one or more recombinantly produced staphylococci proteins and/or polypeptides. For methods of treatment and/or prevention of staphylococcal infections the binding molecules are preferably capable of specifically binding to surface accessible proteins of staphylococci. Surface proteins of staphylococci include, but are not limited to, clumping factor (ClfA and ClfB, SDR-proteins (e.g., SdrC, SdrD, SdrE, SrdF, SdrG and SdrH), Protein A, Sbi, fibronectin-binding protein (FnbA) and serine-rich adhesin for platelets (SraP). In *S. aureus* and *S. epidermidis*, SDR domains of all SDR-containing proteins are heavily glycosylated by at least two glycosyltransferases, SdgA and SdgB, which prevents degradation of these proteins by host proteases, thereby preserving bacterial host tissue interactions. These sugar modifications also represent a dominant antibody epitope. Preferably, the binding molecules bind to glycosylated surface staphylococcal proteins, in particular SdgB glycosylated SDR proteins (Hazenbos et al., "Novel Staphylococcal Glycosyltransferases SdgA and SdgB Mediate Immunogenicity and Protection of Virulence-Associated Cell Wall Proteins," *PLoS Pathog.* 9(10):e1003653 (2013), which is hereby incorporated by reference in its entirety).

As described herein, the binding molecules hereof can comprise intact immunoglobulin molecules such as polyclonal or monoclonal antibodies or antigen-binding fragments including, but not limited to, Fab, F(ab'), F(ab')$_2$, Fv, dAb, Fd, complementarity-determining region (CDR) fragments, single-chain antibodies (scFv), bivalent single-chain antibodies, single-chain phage antibodies, diabodies, triabodies, tetrabodies, and (poly)peptides that contain at least a fragment of an immunoglobulin that is sufficient to confer specific antigen binding to staphylococci or a fragment thereof. In certain embodiments the binding molecules hereof are human monoclonal antibodies.

In one aspect, the first binding domain is a full-length antibody or antibody fragment. Preferably, the full-length antibody or antibody fragment is resistant to proteolytic degradation by a staphylococcal protease that cleaves wild-type IgG1 (such as the staphylococcal protease, *Staphylococcus aureus* V8 protease, that cleaves wild-type IgG1 between or at residues 222-237 (EU numbering) within SEQ ID NO:60). In another aspect, the full-length antibody or antibody fragment is a human, humanized or chimeric antibody or antibody fragment.

In one aspect, the first binding domain comprises an immunoglobulin heavy chain variable (VH) region having the amino acid sequence selected from the group of VH region amino acid sequences of SEQ ID NOs:60, 62, 64 or 66. In another aspect, the first binding domain comprises an immunoglobulin light chain variable (VL) region having the amino acid sequence of SEQ ID NOs:61, 63, 65 or 67. Alternatively, the first binding domain comprises (a) a VH region having the amino acid sequence of SEQ ID NOs:60, 62, 64 or 66; and (b) a VL region having the amino acid sequence of SEQ ID NOs:61, 63, 65 or 67. In on embodiment, the first binding domain comprises (1) a VH region having the amino acid sequence of SEQ ID NO:60, and a VL region having the amino acid sequence of SEQ ID NO:61; (2) a VH region having the amino acid sequence of SEQ ID NO:62, and a VL region having the amino acid sequence of SEQ ID NO:63; (3) a VH region having the amino acid sequence of SEQ ID NO:64, and a VL region having the amino acid sequence of SEQ ID NO:65; (4) a VH region having the amino acid sequence of SEQ ID NO:66, and a VL region having the amino acid sequence of SEQ ID NO:67; (5) a VH region having the amino acid sequence of SEQ ID NO:68, and a VL region having the amino acid sequence of SEQ ID NO:69; (6) a VH region having the amino acid sequence of SEQ ID NO:70, and a VL region having the amino acid sequence of SEQ ID NO:71; (7) a VH region having the amino acid sequence of SEQ ID NO:72, and a VL region having the amino acid sequence of SEQ ID NO:73; (8) a VH region having the amino acid sequence of SEQ ID NO:74, and a VL region having the amino acid sequence of SEQ ID NO:75; (9) a VH region having the amino acid sequence of SEQ ID NO:76, and a VL region having the amino acid sequence of SEQ ID NO:77; or (10) a VH region having the amino acid sequence of SEQ ID NO:78, and a VL region having the amino acid sequence of SEQ ID NO:79.

The binding molecules described herein comprise a second binding domain that is capable of specifically binding to other staphylococcal molecules including, for example, bicomponent toxins. In addition to PVL (also known as leukocidin S/F-PV or LukSF-PV) and gamma-hemolysin (HlgAB and HlgCB), the repertoire of bi-component leukotoxins produced by *S. aureus* is known to include leukocidin E/D ("LukED"), leukocidin A/B ("LukAB") and leukocidin M/F ("LukMF"). Thus, the S-class subunits of these bi-component leukocidins include HlgA, HlgC, LukE, LukS-PV, LukA, and LukM, and the F-class subunits include HlgB, LukD, LukF-PV, LukB, and LukF'-PV. The *S. aureus* S- and F-subunits are not leukocidin-specific. That is, they are interchangeable such that other bi-component combinations could make a functional pore in a white blood cell, greatly increasing the repertoire of leukotoxins (Meyer et al., "Analysis of the Specificity of Panton-Valentine Leucocidin and Gamma-Hemolysin F Component Binding," *Infect. Immun.* 77(1):266-273 (2009), the disclosure of which is hereby incorporated by reference in its entirety).

In one embodiment, the binding molecules of the present invention bind to one or more staphylococcal leukotoxins selected from leukotoxin A (LukA), leukotoxin B (LukB), leukotoxin AB (LukAB), leukotoxin D (LukD), leukotoxin E (LukE), leukotoxin ED (LukED), Panton-Valentine leukocidin S (LukS-PV), Panton-Valentine leukocidin F (LukF-PV), Panton-Valentine leukocidin (LukSF/PVL), gamma hemolysin A (HlgA), gamma hemolysin C (HlgC), gamma hemolysin B (HlgB), gamma hemolysin AB (HlgAB), and gamma-hemolysin BC (HlgBC). In one embodiment, the binding molecule binds to one or more of the staphylococcal leukotoxins selected from LukAB, LukD or LukE In another embodiment, the binding molecules hereof are capable of specifically binding to a fragment of the above-mentioned proteins, wherein the fragment at least comprises an antigenic determinant recognized by the binding molecules hereof. An "antigenic determinant" as used herein, is a moiety that is capable of binding to a binding molecule hereof with sufficiently high affinity to form a detectable antigen-binding molecule complex. In another embodiment, the binding molecules hereof are capable of specifically binding to a fragment of the above-mentioned staphylococcal leukotoxin proteins containing a neutralizing epitope. Binding to a neutralizing epitope of the leukotoxin protein eliminates or substantially eliminates the activity of the protein.

In one aspect, the second binding domain that is capable of binding a staphylococcal leukotoxin is an alternative scaffold. Preferably, the second binding domain comprises a fibronectin type III (FN3) domain, e.g., an isolated, recombinant and/or synthetic protein scaffold based on a consensus sequence of fibronectin type III (FN3) repeat protein.

The FN3 scaffolds of the present invention offer advantages over conventional therapeutics, such as ability to administer locally, orally, or cross the blood-brain barrier, ability to express in *E. coli* allowing for increased expression of protein as a function of resources versus mammalian cell expression, ability to be engineered into bispecific molecules that bind to multiple targets or multiple epitopes of the same target, ability to be conjugated to drugs, polymers, and probes, ability to be formulated to high concentrations, and the ability of such molecules to effectively penetrate diseased tissues.

Moreover, the FN3 scaffolds possess many of the properties of antibodies in relation to their fold that mimics the variable region of an antibody. For example, the orientation of FN3 domains enables the FN3 loops to be exposed similar to antibody complementarity determining regions (CDRs). The loop regions are able to bind to cellular targets and can be altered, e.g., affinity matured, to improve certain binding or related properties.

In one embodiment, the binding molecule described herein comprises one or more FN3 domains. In one aspect, the FN3 domain of the binding molecule is derived from the non-naturally occurring FN domain of Tencon (SEQ ID NO:1). Tencon, like other FN3 domains, has a beta-sandwich structure with seven beta-strands, referred to as A, B, C, D, E, F, and G, linked by six loops, referred to as AB, BC, CD, DE, EF, and FG loops (Bork and Doolittle, *Proc. Natl. Acad. Sci. USA* 89:8990-8992 (1992) and U.S. Pat. No. 6,673,901 to Koide et al., which are hereby incorporated by reference in their entirety). Three of the six loops, i.e., BC, DE, and FG loops, are at the top of the FN3 domain, and three of the loops, i.e., AB, CD, and EF loops, are at the bottom of the FN3 domain. These loops span at or about amino acid residues 13-16, 22-28, 38-43, 51-54, 60-64, and 75-81 of SEQ ID NO:1. Preferably, the loop regions at or about residues 22-28, 51-54, and 75-81 of SEQ ID NO:1 are altered for binding specificity and affinity in the binding molecule described herein. In one aspect, the binding molecules described herein include one or more binding domains that comprise an alternative scaffold comprising at least one, at least two, or all three loops at or about residues 13-16, 22-28, 38-43, 51-54, 60-64, and/or 75-81 of SEQ ID NO:1. In one aspect, the binding molecules include one or more binding domains that comprise an alternative scaffold comprising at least one, at least two, or all three loop regions at or about residues 22-28, 51-54, and 75-81 of SEQ ID NO:1. One or more of these loop regions are randomized with other loop regions and/or other strands maintaining their sequence as backbone portions to populate a library, and potent binders can be selected from the library having high affinity for a particular protein target. One or more of the loop regions can interact with a target protein similar to an antibody CDR interaction with the protein.

As discussed above, FN3 domains contain two sets of CDR-like loops (i.e., BC, DE, and FG loops and AB, CD, and EF loops) on the opposite faces of the molecule. The two sets of loops are separated by beta-strands that form the center of the FN3 structure. Like the loops, these beta-strands can be altered to enhance binding specificity and affinity. Preferably, some or all of the surface exposed residues in the beta strands are randomized without affecting (or minimally affecting) the inherent stability of the scaffold. One or more of the beta-strands can interact with a target protein. The beta-strands in a scaffold provide a flat binding surface (compared to a curved binding surface found in protein scaffolds containing adjacent loops) that effects the target proteins, or specific epitopes on those target proteins, that can be bound effectively by the scaffold. In one aspect, the binding molecules of the present invention includes a binding domain that comprises an alternative scaffold comprising one or more beta-strands that bind to a bacterial virulence factor, e.g., a Staphylococcal leukotoxin.

In one aspect, the second binding domain of the binding molecule comprises a FN3 domain that binds to LukA having the amino acid sequence of SEQ ID NO:10, LukB having the amino acid sequence of SEQ ID NO:11, LukD having the amino acid sequence of SEQ ID NO:12, or LukE having the amino acid sequence of SEQ ID NO:13. Alternatively, the second binding domain of the binding molecule comprises a FN3 domain that binds to a LukAB complex comprising LukA having the amino acid sequence of SEQ ID NO:10 and LukB having the amino acid sequence of SEQ ID NO:11 and/or a LukED complex comprising LukE having the amino acid sequence of SEQ ID NO:13 and LukD having the amino acid sequence of SEQ ID NO:12.

In one aspect, the second binding domain of the binding molecule competes with an FN3 domain having an amino acid sequence of any one of SEQ ID NOs:14-59 or SEQ ID NOs:113-666 for binding to (i) LukA having the amino acid sequence of SEQ ID NO:10; (ii) LukB having the amino acid sequence of SEQ ID NO:11; (iii) LukD having the amino acid sequence of SEQ ID NO:12; and/or (iv) LukE having the amino acid sequence of SEQ ID NO:13.

In yet another aspect, the binding molecule comprises (a) a first binding domain that comprises (i) a VH region having the amino acid sequence of SEQ ID NOs:60, 62, 64 or 66; and (ii) a VL region having the amino acid sequence of SEQ ID NOs:61, 63, 65 or 67; and (b) a second binding domain that comprises the amino acid sequence of any one of SEQ ID NOs:14-59 or SEQ ID NOs:113-666. In one embodiment, the second binding domain comprises the amino acid sequence of SEQ ID NO:14 or SEQ ID NO:22.

In another aspect, the binding molecule comprises one or more additional binding domains, e.g., third, fourth, fifth, etc. binding domains. The additional binding domain(s) are capable of binding to a different glycosylated staphylococcal surface protein than is bound by the first binding domain of the binding molecule, and are capable of binding to a different staphylococcal leukotoxin that is bound by the second binding domain of the binding molecule. In other words, each binding domain of the binding molecule binds to a unique antigen. The additional binding domains of the binding molecule may be immunoglobulin domains, alternative scaffold domains, or a combination thereof.

In one aspect, the binding molecule does not exhibit non-specific binding to other staphylococcal or host (e.g., human) protein antigens. For example, in one aspect, the binding molecule is not capable of specific binding to staphylococcal Protein A or second binding protein for immunoglobulins (Sbi). In another aspect, the binding molecule is not capable of specific binding to FcγRI, in particular human FcγRI.

In another aspect, the binding molecule does retain specific binding capacity to FcRn.

The binding molecules of the present disclosure may incorporate other subunits, e.g., via covalent interaction. All or a portion of an antibody constant region may be attached to the binding molecule to impart antibody-like properties, e.g., complement activity (CDC), half-life, etc. For example, effector function can be provided and/or controlled, e.g., by modifying C1q binding and/or FcγR binding and thereby changing complement dependent cytotoxicity (CDC) and/or antibody-dependent cellular cytotoxicity (ADCC) activity.

"Effector functions" are responsible for activating or diminishing a biological activity (e.g., in a subject). Examples of effector functions include, but are not limited to: Clq binding; CDC; Fc receptor binding; ADCC; phagocytosis; down regulation of cell surface receptors (e.g., B cell receptor; BCR), etc. Such effector functions may require the Fc region to be combined with a binding domain (e.g., protein scaffold loops) and can be assessed using various assays (e.g., Fc binding assays, ADCC assays, CDC assays, etc.). Additionally, a toxin conjugate, albumin or albumin binders, polyethylene glycol (PEG) molecules may be attached to the binding molecule for desired properties. Any of these fusions may be generated by standard techniques, for example, by expression of the binding molecule from a recombinant fusion gene constructed using publically available gene sequences.

The binding molecules of the present disclosure can be used as monospecific in monomeric form or as bi- or multi-specific (for different protein targets or epitopes on the same protein target) in multimer form. The attachments may be covalent or non-covalent. For example, a dimeric bispecific binding molecule has one subunit with specificity for a first target protein or epitope and a second subunit with specificity for a second target protein or epitope. Binding molecule subunits can be joined in a variety of conformations that can increase the valency and thus the avidity of antigen binding.

The binding molecules of the present disclosure may also comprise linker peptides, which are known in the art to connect a protein or polypeptide domain with a biologically active peptide, producing a fusion protein. The linker peptides can be used to make a functional fusion protein from two unrelated proteins that retain the activities of both proteins. For example, an FN3 domain which specifically binds to a leukotoxin can be fused by means of a linker to an antibody, antibody fragment, scFv, or peptide ligand capable of binding to a staphylococcal surface protein to form a fusion protein which binds to the staphylococcal surface protein and neutralizes the harmful leukotoxin effects. Fusion proteins can be produced by art-recognized cloning techniques. For example, an oligonucleotide encoding the linker peptide is ligated between the genes encoding the domains of interest to form one fused gene encoding the entire single-chain protein. The 5' end of the linker oligonucleotide is fused to the 3' end of the first gene, and the 3' end of the linker is fused to the 5' end of the second gene. The entire fused gene can be transfected into a host cell by means of an appropriate expression vector.

Linker peptides of the present invention can vary in length and amino acid composition. For example, a linker peptide of the invention may be from about 2 to about 50 amino acids in length, about 20 to about 45 amino acids in length, about 25 to about 40 amino acids in length, about 30 to about 35 amino acids in length, about 24 to about 27 amino acids in length, or about 20 amino acids in length.

Most linker peptides are composed of repetitive modules of one or more of the amino acids glycine and serine. Exemplary linker peptides include, e.g., $(Gly-Gly)_n$, $(Gly-Ser)_n$ and $(Gly_3-Ser)_n$, wherein $n$ is an integer from 1-25. The length of the linker may be appropriately adjusted as long as it does not affect the function of the polypeptides. The standard 15 amino acid $(Gly_4-Ser)_3$ linker peptide has been well-characterized (e.g., within the context of an antibody single-chain Fv (scFv) domain) and has been shown to adopt an unstructured, flexible conformation. In addition, this linker peptide does not interfere with assembly and binding activity of the domains it connects (Freund et al., "Characterization of the Linker Peptide of the Single-Chain Fv Fragment of an Antibody by NMR Spectroscopy," *FEBS* 320:97 (1993), the disclosure of which is hereby incorporated by reference in its entirety). Accordingly, a particularly effective linker for forming bifunctional fusion proteins comprises a Gly-Ser linker. In one aspect, the linker peptide contains the following amino acid sequence (SEQ ID NO:2):-G-G-G-G-S-G-G-G-G-S-G-G-G-G-S-G-G-G-G-S-.

However, the linker peptides of the invention also contemplate variant forms of this linker peptide, which can be created by introducing one or more nucleotide substitutions, additions or deletions into the nucleotide sequence encoding the linker peptide such that one or more amino acid substitutions, additions or deletions are introduced into the linker peptide. For example, mutations may be introduced by standard techniques, such as site-directed mutagenesis and PCR-mediated mutagenesis. Preferably, conservative amino acid substitutions are made at one or more non-essential amino acid residues such that the ability of the linker peptide is not altered. A "conservative amino acid substitution" is one in which the amino acid residue is replaced with an amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Therefore, a conservative amino acid substitution within the context of a peptide linker comprising a gly-ser motif (e.g., $(Gly-Gly)_n$, $(Gly-Ser)_n$ and $(Gly_3-Ser)_n$) would include substitution of the Gly and/or Ser residue with another uncharged polar side chains (i.e., glycine, asparagine, glutamine, serine, threonine, tyrosine, cysteine).

The binding molecule of the present invention is preferably an "isolated" binding molecule. "Isolated" when used to describe the binding molecule disclosed herein, means a binding molecule that has been identified, separated and/or recovered from a component of its production environment. Preferably, the isolated binding molecule is free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. In preferred embodiments, the binding molecule will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated binding molecule will be prepared by at least one purification step.

Amino acid sequence modifications of the binding molecules described herein are contemplated. For example, it may be desirable to improve the binding affinity and/or other biological properties of the antibody. Amino acid sequence variants of the binding molecules are prepared by introducing appropriate nucleotide changes into the binding molecules nucleic acid, or by peptide synthesis. Such modifications include, for example, deletions from, and/or insertions into, and/or substitutions of, residues within the amino acid sequences of the binding molecules. Any combination of deletion, insertion, and substitution is made to arrive at the final construct, provided that the final construct possesses the desired characteristics, such as abolishment of protein A binding and FcγRI binding, or protease-resistance.

Those amino acid locations demonstrating functional sensitivity to the substitutions then are refined by introducing further or other variants at, or for, the sites of substitution. Thus, while the site for introducing an amino acid sequence variation is predetermined, the nature of the mutation per se needs not to be predetermined. For example, to analyze the performance of a mutation at a given site, Ala scanning or random mutagenesis is conducted at a target codon or region and the expressed binding molecule variants are screened for the desired activity. Preferably, amino acid sequence insertions include amino- and/or carboxyl-terminal fusions ranging in length from 1, 2, 3, 4, 5, 6, 7, 8, 9 or 10 residues to polypeptides containing a hundred or more residues, as well as intrasequence insertions of single or multiple amino acid residues.

Other modifications of the binding molecule are contemplated herein. For example, the binding molecule may be linked to one of a variety of non-proteinaceous polymers, e.g., polyethylene glycol, polypropylene glycol, polyoxyalkylenes, or copolymers of polyethylene glycol and polypropylene glycol. The binding molecule may also be entrapped in microcapsules prepared, for example, by coacervation techniques or by interfacial polymerization (for example, hydroxymethylcellulose or gelatine-microcapsules and poly(methylmethacylate) microcapsules, respectively), in colloidal drug delivery systems (for example, liposomes, albumin microspheres, microemulsions, nanoparticles and nanocapsules), or in macroemulsions. Such techniques are disclosed in REMINGTON'S PHARMACEUTICAL SCIENCES, 16th edition, Oslo, A., Ed., (1980), which is hereby incorporated by reference in its entirety.

For therapeutic use, the binding molecules described herein may be prepared as pharmaceutical compositions containing an effective amount of the binding molecules as an active ingredient in a pharmaceutically acceptable carrier. The term "carrier" refers to a diluent, adjuvant, excipient, or vehicle with which the active compound is administered. Such vehicles can be liquids, such as water and oils, including those of petroleum, animal, vegetable or synthetic origin, such as peanut oil, soybean oil, mineral oil, sesame oil and the like. For example, 0.4% saline and 0.3% glycine can be used. These solutions are sterile and generally free of particulate matter. They may be sterilized by conventional, well-known sterilization techniques (e.g., filtration). The compositions may contain pharmaceutically acceptable auxiliary substances as required to approximate physiological conditions such as pH adjusting and buffering agents, stabilizing, thickening, lubricating and coloring agents, etc. The concentration of the agent of the invention in such pharmaceutical formulation can vary widely, i.e., from less than about 0.5%, usually at or at least about 1% to as much as 15 or 20% by weight and will be selected primarily based on required dose, fluid volumes, viscosities, etc., according to the particular mode of administration selected. Suitable vehicles and formulations, inclusive of other human proteins, e.g., human serum albumin, are described, for example, in e.g. REMINGTON: THE SCIENCE AND PRACTICE OF PHARMACY, 21$^{st}$ Edition, Troy, D. B. ed., Lipincott Williams and Wilkins, 2006, *Part* 5, Pharmaceutical Manufacturing pp 691-1092, see especially pp. 958-989, which is hereby incorporated by reference in its entirety.

The binding molecules described herein can be used in non-isolated or isolated form. Furthermore, the binding molecules hereof can be used alone or in a mixture comprising at least one binding molecule hereof. In other words, the binding molecules can be used in combination, e.g., as a pharmaceutical composition comprising two or more binding molecules hereof, variants or fragments thereof. For example, binding molecules having different, but complementary activities can be combined in a single therapy to achieve a desired therapeutic effect, but alternatively, binding molecules having identical activities can also be combined in a single therapy to achieve a desired prophylactic, therapeutic or diagnostic effect. Optionally, the mixture further comprises at least one other therapeutic agent. In one aspect, the other therapeutic agent may be an anti-infective agent, an antibiotic agent, and/or an antimicrobial agent that is useful in the prophylaxis and/or treatment of a staphylococcal infection. In another aspect, the other therapeutic agent may be an agent that is useful in the prophylaxis and/or treatment of a condition associated with a staphylococcal infection.

A method of producing a binding molecule hereof is an additional part of the disclosure. Such a method comprises the steps of (a) culturing a host cell comprising a vector containing a nucleic acid sequence(s) encoding the binding molecule under conditions suitable for production of the binding molecule, and (b) recovering the binding molecule from the culture. The host cell is preferably a mammalian host cell, such as a non-human mammalian host cell. Accordingly, another aspect relates to nucleic acid molecules encoding the binding molecules (or a fragment thereof). These nucleic acid molecules may be inserted into a vector, i.e., an expression vector, and then transformed (or transfected) in an appropriate host cell and/or expressed in a transgenic animal. The binding molecules (or fragments thereof) so expressed may then be isolated by methods known in the art. See e.g., Maniatis et al., MOLECULAR CLONING: A LABORATORY MANUAL [3$^{rd}$ Ed.] Cold Spring Harbor Laboratory Press (2001), which is hereby incorporated by reference in its entirety.

The recombinant vectors of the invention comprise a nucleic acid of the invention in a form suitable for expression of the nucleic acid in a host cell, which means that the recombinant expression vectors include one or more regulatory sequences, selected on the basis of the host cells to be used for expression, that is operatively-linked to the nucleic acid sequence to be expressed. Within a recombinant expression vector, "operably-linked" is intended to mean that the nucleotide sequence of interest is linked to the regulatory sequence(s) in a manner that allows for expression of the nucleotide sequence (e.g., in an in vitro transcription/translation system or in a host cell when the vector is introduced into the host cell).

The term "regulatory sequence" is intended to include promoters, enhancers and other expression control elements (e.g., polyadenylation signals). Such regulatory sequences are described, for example, in Goeddel GENE EXPRESSION TECHNOLOGY: METHODS IN ENZYMOLOGY 185, Academic Press (1990), which is hereby incorporated by reference in its entirety. Regulatory sequences include those that direct constitutive expression of a nucleotide sequence in many types of host cell and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired. The expression vectors of the invention can be introduced into host cells to thereby produce proteins or peptides, including fusion proteins or peptides, encoded by nucleic acids as described herein.

The host cell may be co-transfected with the two or more expression vectors as described herein, the first expression vector containing DNA encoding an operon and a first binding domain (e.g., an antibody or antibody fragment that binds to a glycosylated staphylococcal surface protein) and the second vector containing DNA encoding an operon and a second binding domain (e.g., an alternative scaffold, such as FN3, that binds to a staphylococcal leukotoxin). The two vectors contain different selectable markers, but preferably achieve substantially equal expression of the first binding domain and the second binding domain polypeptides. Alternatively, a single vector may be used, the vector including DNA encoding both the first binding domain and the second binding domain. The coding sequences for the first binding domain and the second binding domain may comprise cDNA, genomic DNA, or both.

The recombinant expression vectors of the invention may be designed for production of binding molecules in prokaryotic or eukaryotic cells. For example, binding molecules of the invention can be expressed in bacterial cells such as *Escherichia coli*, insect cells (e.g., using baculovirus expression vectors), yeast cells, or mammalian cells. Suitable host cells are discussed further in Goeddel, GENE EXPRESSION TECHNOLOGY: METHODS IN ENZYMOLOGY 185, Academic Press (1990), which is hereby incorporated by reference in its entirety. Alternatively, the recombinant expression vector can be transcribed and translated in vitro, for example using T7 promoter regulatory sequences and T7 polymerase.

Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, to the amino or carboxy terminus of the recombinant protein. Such fusion vectors typically serve three purposes: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin, PreScission, TEV and enterokinase. Typical fusion expression vectors include pGEX (Pharmacia Biotech Inc; Smith and Johnson, "Single-Step Purification of Polypeptides Expressed in *Escherichia coli* as Fusions With Glutathione S-Transferase," *Gene* 67:31-40 (1988), which is hereby incorporated by reference in its entirety), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

A recombinant mammalian expression vector is capable of directing expression of the nucleic acid in a particular cell type (e.g., tissue-specific regulatory elements are used to express the nucleic acid). Tissue-specific regulatory elements are known in the art. For efficient production of the binding molecule described herein, it is preferable to place the nucleotide sequences encoding the binding molecule under the control of expression control sequences optimized for expression in a desired host. For example, the sequences may include optimized transcriptional and/or translational regulatory sequences (e.g., altered Kozak sequences).

One strategy to maximize recombinant protein expression in *E. coli* is to express the protein in a host bacterium with an impaired capacity to proteolytically cleave the recombinant protein (see e.g., Gottesman, GENE EXPRESSION TECHNOLOGY: METHODS IN ENZYMOLOGY Academic Press 185:119-128 (1990), which is hereby incorporated by reference in its entirety). Another strategy is to alter the nucleic acid sequence of the nucleic acid to be inserted into an expression vector so that the individual codons for each amino acid are those preferentially utilized in *E. coli* (see, e.g., Wada et al., "Codon Usage Tabulated From the GenBank Genetic Sequence Data," *Nucl. Acids Res.* 20:2111-2118 (1992), which is hereby incorporated by reference in its entirety). Such alteration of nucleic acid sequences can be carried out by standard DNA synthesis techniques. Another strategy to solve codon bias is by using BL21-codon plus bacterial strains (Invitrogen) or Rosetta bacterial strain (Novagen), these strains contain extra copies of rare *E. coli* tRNA genes.

The expression vector encoding the binding molecules described herein may be a yeast expression vector. Examples of vectors for expression in yeast *Saccharomyces cerevisiae* include pYepSec1 (Baldari et al., "A Novel Leader Peptide Which Allows Efficient Secretion of a Fragment of Human Interleukin 1 beta in *Saccharomyces cerevisiae*," *EMBO J.* 6:229-234 (1987), which is hereby incorporated by reference in its entirety), pMFa (Kurjan and Herskowitz, "Structure of a Yeast Pheromone Gene (MF alpha): a Putative Alpha-Factor Precursor Contains Four Tandem Copies of Mature Alpha-Factor," *Cell* 30:933-943 (1982), which is hereby incorporated by reference in its entirety), pJRY88 (Schultz et al., "Expression and Secretion in Yeast of a 400-kDa Envelope Glycoprotein Derived From Epstein-Barr Virus," *Gene* 54:113-123 (1987), which is hereby incorporated by reference in its entirety), pYES2 (Invitrogen Corporation, San Diego, Calif.), and picZ (Invitrogen Corp, San Diego, Calif.)

Alternatively, the binding molecules described herein can be produced in insect cells using baculovirus expression vectors. Baculovirus vectors available for expression of proteins in cultured insect cells (e.g., SF9 cells) include the pAc series (Smith et al., "Production of Human Beta Interferon in Insect Cells Infected With a Baculovirus Expression Vector," *Mol. Cell. Biol.* 3:2156-2165 (1993), which is hereby incorporated by reference in its entirety) and the pVL series (Luckow et al., "High Level Expression of Nonfused Foreign Genes With *Autographa californica* Nuclear Polyhedrosis Virus Expression Vectors," *Virology* 170:31-39 (1989), which is hereby incorporated by reference in its entirety). In yet another embodiment, a nucleic acid of the invention is expressed in mammalian cells using a mammalian expression vector. Examples of mammalian expression vectors include pCDM8 (Seed, B., "An LFA-3 cDNA Encodes a Phospholipid-Linked Membrane Protein Homologous to its Receptor CD2," *Nature* 329:840 (1987), which is hereby incorporated by reference in its entirety) and pMT2PC (Kaufman et al., "Translational Efficiency of Polycistronic mRNAs and Their Utilization to Express Heterologous Genes in Mammalian Cells," *EMBO J.* 6:187-193 (1987), which is hereby incorporated by reference in its entirety), pIRESpuro (Clontech), pUB6 (Invitrogen), pCEP4 (Invitrogen) pREP4 (Invitrogen), pcDNA3 (Invitrogen). When used in mammalian cells, the expression vector's control functions are often provided by viral regulatory elements. For example, commonly used promoters are derived from polyoma, adenovirus 2, cytomegalovirus, Rous Sarcoma Virus, and simian virus 40. For other suitable expression systems for both prokaryotic and eukaryotic cells see, e.g., Sambrook, et al. (Eds.) MOLECULAR CLONING: A LABORATORY MANUAL ($3^{rd}$ Ed.) Cold Spring Harbor Laboratory (2001), which is hereby incorporated by reference in its entirety.

A host cell can be any prokaryotic or eukaryotic cell. For example, binding molecules of the invention can be produced in bacterial cells such as *E. coli*, insect cells, yeast, plant or mammalian cells (e.g., Chinese hamster ovary cells (CHO), COS, HEK293 cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. [Eds.] MOLECULAR CLONING: A LABORATORY MANUAL ($3^{rd}$ Ed.) Cold Spring Harbor Laboratory and other laboratory manuals (2001), which is hereby incorporated by reference in its entirety.

Any of the well-known procedures for introducing foreign nucleotide sequences into host cells may be used. These include the use of calcium phosphate transfection, polybrene, protoplast fusion, electroporation, liposomes, microinjection, plasma vectors, viral vectors and any of the other well known methods for introducing cloned genomic DNA, cDNA, synthetic DNA or other foreign genetic material into a host cell. See e.g., Sambrook, et al. (Eds.) MOLECULAR CLONING: A LABORATORY MANUAL ($3^{rd}$ Ed.) Cold Spring Harbor Laboratory (2001) and Walker & Papley MOLECULAR BIOLOGY AND BIOTECHNOLOGY ($5^{th}$ Ed.) Royal Society of Chemistry (2009), which are hereby incorporated by reference in their entirety. It is only necessary that the particular genetic engineering procedure used be capable of successfully introducing at least one nucleic acid molecule into a host cell capable of expressing the binding molecule or binding molecules of interest.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Various selectable markers include those that confer resistance to drugs, such as G418, hygromycin, puromycin, blasticidin and methotrexate. Nucleic acids encoding a selectable marker can be introduced into a host cell on the same vector as that encoding the binding molecule or binding molecules as described herein, or can be introduced on a separate vector. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce (i.e., express) the binding molecule of the invention. Accordingly, the invention further provides methods for producing binding molecules of the invention using the host cells of the invention. In one embodiment, the method comprises culturing the host cell of the present invention (into which a recombinant expression vector encoding a binding molecule as described herein has been introduced) in a suitable medium such that binding molecule or binding molecules of the invention are produced. In another embodiment, the method further comprises isolating the binding molecules of the invention from the medium or the host cell.

After the expression vector is introduced into the cells, the transfected cells are cultured under conditions favoring expression of the binding molecule or binding molecules of interest, which is then recovered from the culture using standard techniques. Examples of such techniques are well known in the art (see, e.g., WO00/06593 to Zuker et al., which is hereby incorporated by reference in its entirety).

Furthermore, the binding molecules of the present invention can be used for the treatment, prevention or amelioration of a staphylococcal infection. The staphylococcal infection may be caused by any *Staphylococcus* spp. In one aspect, the staphylococcal infection is caused by *Staphylococcus aureus*, including MRSA and MSSA strains of *S. aureus*. Accordingly, the present disclosure provides a method for the treatment, prevention or amelioration of a staphylococcal infection that involves administering to a subject in need thereof a binding molecule as described herein.

In accordance with this aspect, the target "subject" encompasses any animal, for example, a mammal, such as a human. In the context of administering a composition of the invention for purposes of preventing a staphylococcal infection in a subject, the target subject encompasses any subject that is at risk of becoming infected with *staphylococcus* or developing a staphylococcal infection. Susceptible subjects include infants and juveniles, as well as immunocompromised juvenile, adults, and elderly adults. However, any infant, juvenile, adult, or elderly adult or immunocompromised individual at risk for developing a staphylococcal infection can be treated in accordance with the methods described herein. In the context of administering a composition of the invention for purposes of treating a staphylococcal infection in a subject, the target subject population encompasses any subject infected with *staphylococcus*. Particularly suitable subjects include those at risk of infection or those infected with methicillin-resistant *S. aureus* (MRSA) or methicillin sensitive *S. aureus* (MSSA). Other suitable subjects include those subjects which may have or are at risk for developing a condition resulting from a *staphylococcus* infection, i.e., a staphylococcal associated condition, such as, for example, skin wounds and infections, tissue abscesses, folliculitis, osteomyelitis, pneumonia, scalded skin syndrome, septicemia, septic arthritis, myocarditis, endocarditis, and toxic shock syndrome.

In one embodiment, the binding molecules described herein are administered prophylactically to prevent, delay, or inhibit the development of staphylococcal infection in a subject at risk of developing a staphylococcal infection or associated condition. In one aspect, prophylactic administration of one or more binding molecules described herein is effective to fully prevent *S. aureus* infection in an individual. In other embodiments, prophylactic administration is effective to prevent the full extent of infection that would otherwise develop in the absence of such administration, i.e., substantially prevent, inhibit, or minimize staphylococcal infection in an individual.

In another embodiment, the binding molecules described herein are administered therapeutically to an individual having a staphylococcal infection to inhibit the progression and further development of the infection, i.e., to inhibit and/or prevent the spread of the infection to other cells in an individual, decrease infection, and to treat or alleviate one or more symptoms of infection.

Therapeutically effective amounts of the binding molecules described herein can be determined in accordance with standard procedures, which take numerous factors into account, including, for example, the concentrations of the binding molecules in a pharmaceutical composition, the mode and frequency of administration, the severity of the *staphylococcus* infection to be treated (or prevented), and subject details, such as age, weight and overall health and immune condition. General guidance can be found, for example, in the publications of the International Conference on Harmonization and in REMINGTON'S PHARMACEUTICAL SCIENCES (Mack Publishing Company 1990), which is hereby incorporated by reference in its entirety. A clinician may administer a composition comprising the binding molecules described herein in a single dose or in accordance with a multi-dosing protocol until a dosage is reached that provides the desired or required prophylactic or therapeutic effect. The progress of this therapy can be easily monitored by conventional assays. In prophylactic applications, a relatively low dosage is administered at relatively infrequent intervals over a long period of time. In therapeutic applications, a relatively high dosage at relatively short intervals is sometimes required until progression of the disease is reduced or terminated, and preferably until the subject shows partial or complete amelioration of symptoms of disease.

The therapeutic compositions of the present invention can be administered alone or as part of a combination therapy in conjunction with one or more other active agents, depending upon the nature of the *staphylococcus* infection that is being treated. Such additional active agents include anti-infective agents, antibiotic agents, and antimicrobial agents that are readily known in the art.

The mode of administration of the binding molecules described herein may be any suitable route that delivers the binding molecule(s) to the host, such as parenteral administration, e.g., intradermal, intramuscular, intraperitoneal, intravenous or subcutaneous, pulmonary; transmucosal (oral, intranasal, intravaginal, rectal); using a formulation in a tablet, capsule, solution, powder, gel, particle; and contained in a syringe, an implanted device, osmotic pump, cartridge, micropump; or other means appreciated by the skilled artisan, as well known in the art. Site specific administration may be achieved by, for example, intraarticular, intrabronchial, intraabdominal, intracapsular, intracartilaginous, intracavitary, intracelial, intracerebellar, intracerebroventricular, intracolic, intracervical, intragastric, intrahepatic, intracardial, intraosteal, intrapelvic, intrapericardiac, intraperitoneal, intrapleural, intraprostatic, intrapulmonary, intrarectal, intrarenal, intraretinal, intraspinal, intrasynovial, intrathoracic, intrauterine, intravascular, intravesical, intralesional, vaginal, rectal, buccal, sublingual, intranasal, or transdermal delivery.

The binding molecules provided herein can also be used in methods for diagnosing a staphylococcal infection in a subject. In one aspect, the method for diagnosing a staphylococcal infection involves contacting a binding molecule as described herein with a sample from the subject to be diagnosed, and detecting a glycosylated staphylococcal surface protein and/or a staphylococcal leukotoxin in the sample, i.e., detecting the presence or the absence of the glycosylated staphylococcal surface protein and/or a staphylococcal leukotoxin in the sample. A staphylococcal infection is diagnosed in the subject based on this detection. In other words, the detection of the glycosylated staphylococcal surface protein and/or the staphylococcal leukotoxin indicates a positive diagnosis of a staphylococcal infection.

In accordance with this aspect, the sample from the subject may comprise a blood, tissue, cell, serum, or other biological sample.

Another aspect relates to a method for the detection of a staphylococcal infection in a sample. This method involves contacting the binding molecule as described herein with a sample, and detecting the presence or the absence of a glycosylated staphylococcal surface protein and/or a staphylococcal leukotoxin. The detection of the glycosylated staphylococcal surface protein and/or the staphylococcal leukotoxin indicates the presence of *staphylococcus* in the sample. In accordance with this aspect, the sample may be any biological sample obtained from the environment, an animal, or a human.

Methods described herein involving the detection of a glycosylated staphylococcal surface protein and/or staphylococcal leukotoxin in a sample from a subject or elsewhere involve the use of a detectably labeled binding molecule. Accordingly, in one aspect the binding molecule as described herein may be coupled to a detectable label. Suitable detectable labels are well known in the art and include detectable tags (e.g., a poly-histidine ($His_6$-) tag, a glutathione-S-transferase (GST-) tag, or a maltose-binding protein (MBP-) tag); radioactive labels (e.g., carbon ($^{14}C$) or phosphorous ($^{32}P$)); fluorescent labels (e.g., fluorescein and derivatives thereof, fluorescein isothiocyanate, rhodamine and derivatives thereof, dichlorotriazinylamine fluorescein, dansyl chloride or phycoerythrin); luminescent labels (e.g., luminol); bioluminescent labels (e.g., luciferase, luciferin, and aequorin); or enzymatic labels (e.g., luciferin, 2,3-dihydrophthalazinediones, malate dehydrogenase, urease, peroxidases (e.g., horseradish peroxidase), alkaline phosphatase, β-galactosidase, glucoamylase, lysozyme, saccharide oxidases (e.g., glucose oxidase, galactose oxidase, and glucose-6-phosphate dehydrogenase), heterocyclic oxidases (e.g., uricase and xanthine oxidase), lactoperoxidase, microperoxidase). Alternatively, the binding molecule can be bound by a detectable label, for example, bound by a secondary antibody that contains a detectable label.

Detection assays for detecting the labeled binding molecule bound to a glycosylated staphylococcal surface protein and/or staphylococcal leukotoxin in a sample are well known in the art and include, for example, immunoprecipitation, enzyme-linked immunosorbent assay (ELISA), radioimmunoassay (RIA), or fluorescent activated cell sorting (FACS).

Furthermore, the binding molecules of the present invention can be used for the prevention of a staphylococcal infection. This method involves contacting the binding molecule as described herein with a sample from a subject, and detecting a glycosylated staphylococcal surface protein and/or a staphylococcal leukotoxin in the sample as a result of the contacting. If a glycosylated staphylococcal surface protein and/or a staphylococcal leukotoxin is detected in the subject sample, then an agent suitable for preventing staphylococcal infection is administered to the subject. Exemplary prophylactic agents include, but are not limited to; the binding molecules described herein, one or more antibiotics (e.g., mupirocin, nafcillin, cefazolin, dicloxacillin, clindamycin, vancomycin, linezolid, rifampin, sulfamethoxazole-trimethoprim), and/or other anti-infective agents that are effective against staphylococcal infection.

EXAMPLES

Examples are provided below to illustrate the present invention. These examples are not meant to constrain the present invention to any particular application or theory of operation.

Example 1

Construction and Selection of Fibronectin Type III (FN3) Domains that Bind and Neutralize Leukotoxins Tencon (SEQ ID NO:1) is an immunoglobulin-like scaffold, fibronectin type III (FN3) domain, designed from a consensus sequence of fifteen FN3 domains from human tenascin-C (Jacobs et al., "Design of Novel FN3 Domains With High Stability by a Consensus Sequence Approach," *Protein Engineering, Design, and Selection* 25:107-117 (2012), the disclosure of which is hereby incorporated by reference in its entirety). The crystal structure of Tencon shows six surface-exposed loops that connect seven beta-strands. These loops, or selected residues within each loop, can be randomized in order to construct libraries of fibronectin type III (FN3) domains that can be used to select novel molecules that bind to LukAB, LukD, or LukE Tencon:
(SEQ ID NO: 1)
LPAPKNLVVSRVTEDSARLSWTAPDAAFDSFLIQYQESEKVGEAINLTVP
GSERSYDLTGLKPGTEYTVSIYGVKGGHRSNPLSAEFTT Procedure Construction of TCL7 (TCL18) and TCL9 (TCL17) Libraries.

Libraries designed to randomize only the F:G loop of Tencon, TCL9 (TCL17), or a combination of the BC and FG loops, TCL7 (TCL18), were constructed for use with the cis-display system (Odegrip et al., "CIS Display: In Vitro Selection of Peptides From Libraries of Protein-DNA Complexes," *Proc. Natl. Acad. Sci. USA* 101:2806-2810 (2004), the disclosure of which is hereby incorporated by reference in its entirety). In this system, linear double-stranded DNA incorporating sequences for a Tac promoter, Tencon library coding sequence, RepA coding sequence, cis-element, and on element is produced. Upon expression in an in vitro transcription/translation system, a complex of the FN3 domain-RepA fusion protein bound in cis to the DNA from which it is encoded is formed. Complexes that bind to a target molecule are then isolated and amplified by polymerase chain reaction (PCR), as described below.

DNA fragments encoding the Tencon gene sequence with randomized BC or FG loop sequences were synthesized using Slonomics technology (Sloning Biotechnology GmbH) so as to control the amino acid distribution of the library and to eliminate stop codons. Two different sets of DNA molecules randomizing either the BC loop or the FG loops were synthesized independently and later combined as described below so that libraries with different combinations of loop lengths were produced. Table 1 below summarizes the design characteristics of these Tencon loop libraries.

TABLE 1

Designed amino acid sequences of the BC and FG loops of the TCL7 (TCL18) and TCL9 (TCL17) libraries. The sequence of the unrandomized Tencon BC and FG loops is shown for comparison. X represents a mixture of 18 amino acids devoid of cysteine and methionine.

| Library | B:C Loop Design | F:G Loop Design |
|---|---|---|
| Tencon | TAPDAA (SEQ ID NO: 3) | KGGHRSN (SEQ ID NO: 4) |
| TCL7 (TCL18) | $X_{6-9}$ | $X_{7-10}$SN |
| TCL9 (TCL17) | TAPDAA (SEQ ID NO: 3) | $X_{7-12}$SN |

Production of FG Loop Libraries (TCL9 (TCL17)).

A set of synthetic DNA molecules consisting of a 5' Tac promoter followed by the complete gene sequence of Tencon with the exception of randomized codons in the FG loop was produced (U.S. Pat. Publ. No. 2013/0079243 to Diem et al., which is hereby incorporated by reference in its entirety). For FG loop randomization, all amino acids except cysteine and methionine were encoded at equal percentages. The lengths of the diversified portion are such that they encode for 7, 8, 9, 10, 11, or 12 amino acids in the FG loop. Sub-libraries of each length variation were synthesized individually at a scale of 2 ug and then amplified by PCR using oligos Sloning-FOR and Sloning-Rev.

The 3' fragment of the library is a constant DNA sequence containing elements for display, including a PspOMI restriction site, the coding region of the repA gene, and the cis- and on elements. PCR reactions were performed to amplify this fragment using a plasmid (pCR4Blunt) (Invitrogen) as a template with M13 Forward and M13 Reverse primers. The resulting PCR products were digested by PspOMI overnight and gel-purified. To ligate the 5' portion of library DNA to the 3' DNA containing repA gene, 2 pmol (~540 ng to 560 ng) of 5' DNA was ligated to an equal molar (~1.25 ug) of 3' repA DNA in the presence of NotI and PspOMI enzyme and T4 ligase at 37° C. overnight. The ligated library product was amplified by using 12 cycles of PCR with oligos POP2250 (SEQ ID NO:6) and DigLigRev (SEQ ID NO:7). For each sub-library, the resulting DNA from 12 PCR reactions were combined and purified by Qiagen spin column. The yield for each sub-library of TCL9 (TCL17) ranged from 32-34 ug.

TCL7 (TCL18) Library Construction.

The TCL7 (TCL18) library provides for a library with randomized Tencon BC and FG loops. In this library BC loops of lengths 6-9 amino acids were mixed combinatorially with randomized FG loops of 7-12 amino acids in length. Synthetic Tencon fragments BC6, BC7, BC8, and BC9 (SEQ ID NOs:80-83, respectively) were produced to include the Tencon gene encoding for the N-terminal portion of the protein up to and including residue VX such that the BC loop is replaced with either 6, 7, 8, or 9 randomized amino acids. These fragments were synthesized prior to the discovery of L17A, N46V and E86I mutations (CEN5243) but these mutations were introduced in the molecular biology steps described below. In order to combine this fragment with fragments encoding for randomized FG loops, the following steps were taken.

First, a DNA fragment encoding the Tac promoter and the 5' sequence of Tencon up to the nucleotide encoding for amino acid A17 (130mer-L17A) (SEQ ID NO:84) was produced by PCR using oligos POP2222ext (SEQ ID NO:85) and LS1114 (SEQ ID NO:86). This was done to include the L17A mutation in the library. Next, DNA fragments encoding for Tencon residues R18-V74 including randomized BC loops were amplified by PCR using BC6, BC7, BC8, or BC9 as a templates and oligos LS1115 (SEQ ID NO:87) and LS1117 (SEQ ID NO:88). This PCR step introduced a BsaI site at the 3' end. These DNA fragments were subsequently joined by overlapping PCR using oligos POP2222ext and LS1117 as primers. The resulting PCR product of 240 bp was pooled and purified by Qiagen PCR purification kit. The purified DNA was digested with BsaI-HF and gel purified.

Fragments encoding the FG loop were amplified by PCR using FG7, FG8, FG9, FG10, FG11, and FG12 as templates with oligonucleotides SDG10 (SEQ ID NO:89) and SDG24 (SEQ ID NO:90) to incorporate a BsaI restriction site and N46V and E86I variations.

The digested BC fragments and FG fragments were ligated together in the 16 possible combinations as 4 ligation reactions in combinations of two BC loop lengths with 2 FG loop lengths. Each ligation contained ~300 ng of total BC fragment and 300 ng of the FG fragment. These 4 ligation pools were then amplified by PCR using oligos POP2222 (SEQ ID NO:5) and SDG28 (SEQ ID NO:91). 7.5 ug of each reaction product were then digested with Not1 and cleaned up with a Qiagen PCR purification column. 5.2 ug of this DNA, was ligated to an equal molar amount of RepA DNA fragment (~14 ug) digested with PspOMI and the product amplified by PCR using oligos POP2222.

Design of TCL19, TCL21, TCL23, and TCL24 Libraries.

The choice of residues to be randomized in a particular library design governs the overall shape of the interaction surface created. X-ray crystallographic analysis of an FN3 domain containing scaffold protein selected to bind maltose binding protein (MBP) from a library in which the BC, DE, and FG loops were randomized was shown to have a largely curved interface that fits into the active site of MBP (Koide et al., "High-Affinity Single-Domain Binding Proteins With a Binary-Code Interface," *Proc. Natl. Acad. Sci. USA* 104: 6632-6637 (2007), which is hereby incorporated by reference in its entirety. In contrast, an ankyrin repeat scaffold protein that was selected to bind to MBP was found to have a much more planar interaction surface and to bind to the outer surface of MBP distant from the active site (Binz et al., High-Affinity Binders Selected From Designed Ankyrin Repeat Protein Libraries," *Nat. Biotechnol.* 22:575-82 (2004), which is hereby incorporated by reference in its entirety). These results suggest that the shape of the binding surface of a scaffold molecule (curved vs. flat) may dictate what target proteins or specific epitopes on those target proteins are able to be bound effectively by the scaffold. Published efforts around engineering protein scaffolds containing FN3 domains for protein binding have relied on engineering adjacent loop for target binding, thus producing curved binding surfaces. This approach may limit the number of targets and epitopes accessible by such scaffolds.

Tencon and other FN3 domains contain two sets of CDR-like loops lying on the opposite faces of the molecule, the first set formed by the BC, DE, and FG loops, and the second set formed by the AB, CD, and EF loops. The two sets of loops are separated by the beta-strands that form the center of the FN3 structure. This slightly concave surface is formed by the CD and FG loops and two antiparallel beta-strands, the C and the F beta-strands, and is herein called the C-CD-F-FG surface. The C-CD-F-FG surface can be used as a template to design libraries of protein scaffold interaction surfaces by randomizing a subset of residues that form the surface. Beta-strands have a repeating structure with the side chain of every other residue exposed to the surface of the protein. Thus, a library can be made by randomizing some or all surface exposed residues in the beta strands. By choosing the appropriate residues in the beta-strands, the inherent stability of the Tencon scaffold should be minimally compromised while providing a unique scaffold surface for interaction with other proteins. A library built upon this premise, called TCL14 was previously described in US2013/0079243A1 to Diem et al, which is hereby incorporated by reference in its entirety. A new library was then created under a very similar design to that of TCL14. Whereas TCL14 used degenerate NNS codons to diversify the Tencon scaffold, TCL19 (SEQ ID NO:86) was generated using DNA fragments encoding the Tencon gene synthesized using Slonomics technology (Sloning Biotechnology GmbH) so as to control the amino acid distribution of the library and to eliminate stop codons. Thus, each position shown with an "X" below was replaced with an equal mixture of 18 amino acids (no cysteine or methionine).

TCL19:
(SEQ ID NO: 92)
LPAPKNLVVSRVTEDSARLSWTAPDAAFDSF<u>XIXYXEXXXX</u>GEAIVLTVP

GSERSYDLTGLKPGTEY<u>XVXIX</u>GVKGG<u>XXSX</u>PLSAIFTT;

wherein "X" is an equal mixture of 18 amino acids (no cysteine or methionine).

TABLE 2

| Region | Amino acid positions (in SEQ ID NO: 92) | Amino acid sequence | SEQ ID NO: |
|---|---|---|---|
| C strand | 29-37 | DSFXIXYXE | 93 |
| F strand | 65-74 | TEYXVXIXGV | 94 |
| C strand + CD loop | 29-43 | DSFXIXYXEXXXXGE | 95 |
| F strand + FG loop | 65-81 | TEYXVXIXGVKGGXXSX | 96 |
| A strand + AB loop + B strand + BC loop | 1-28 | LPAPKXLVXXVXXXXAXL XWXAPDAAF | 97 |
| E strand | 55-59 | XYXLT | 98 |

Two additional Tencon libraries of similar design were produced. These two libraries, TCL21 and TCL23, are randomized at the same positions as TCL14 (described in US2013/0079243A1 to Diem et al., which is hereby incorporated by reference in its entirety); however, the distribution of amino acids occurring at these positions is altered (Table 3 below). TCL21 was designed to include an equal distribution of 18 natural amino acids at every position (5.55% of each), excluding only cysteine and methionine. TCL23 was designed such that each randomized position approximates the amino acid distribution found in the CDR-H3 loops of functional antibodies (Birtalan et al., "The Intrinsic Contributions of Tyrosine, Serine, Glycine and Arginine to the Affinity and Specificity of Antibodies," *Journal of Molecular Biology* 377:1518-1528 (2008), which is hereby incorporated by reference in its entirety) as described in Table 3. As with the TCL21 library, cysteine and methionine were excluded.

A third additional library was built to expand potential target binding surface of the TCL21 library. In this library, TCL24, 4 additional Tencon positions were randomized as compared to libraries TCL14, TCL21, and TCL23. These positions include N46 and T48 from the D strand and S84 and I86 from the G strand. Positions 46, 48, 84, and 86 were chosen in particular as the side chains of these residues are surface exposed from beta-strands D and G and lie structurally adjacent to the randomized portions of the C and F strand, thus increasing the surface area accessible for binding to target proteins. The amino acid distribution used at each position for TCL24 is identical to that described for TCL21 and in Table 3.

TCL24:
(SEQ ID NO: 667)
LPAPKNLVVSRVTEDSARLSWTAPDAAFDSFXIXYXEXXXXGEAIXLXVP

GSERSYDLTGLKPGTEYXVXIXGVKGGXXSXPLXAXFTT wherein "X" represents an equal mixture of 18 natural amino acids.

TABLE 3

Amino acid frequency (%) at each randomized position for TCL21, TCL23, and TCL24.

| Amino Acid | TCL21 | TCL23 | TCL24 |
|---|---|---|---|
| Ala | 5.6 | 6.0 | 5.6 |
| Arg | 5.6 | 6.0 | 5.6 |
| Asn | 5.6 | 3.9 | 5.6 |
| Asp | 5.6 | 7.5 | 5.6 |
| Cys | 0.0 | 0.0 | 0.0 |
| Gln | 5.6 | 1.5 | 5.6 |
| Glu | 5.6 | 2.5 | 5.6 |
| Gly | 5.6 | 15.0 | 5.6 |
| His | 5.6 | 2.3 | 5.6 |
| Ile | 5.6 | 2.5 | 5.6 |
| Leu | 5.6 | 5.0 | 5.6 |
| Lys | 5.6 | 1.5 | 5.6 |
| Met | 0.0 | 0.0 | 0.0 |
| Phe | 5.6 | 2.5 | 5.6 |
| Pro | 5.6 | 4.0 | 5.6 |
| Ser | 5.6 | 10.0 | 5.6 |
| Thr | 5.6 | 4.5 | 5.6 |
| Trp | 5.6 | 4.0 | 5.6 |
| Tyr | 5.6 | 17.3 | 5.6 |
| Val | 5.6 | 4.0 | 5.6 |

Generation of TCL21, TCL23, and TCL24 libraries. The TCL21 library was generated using Colibra library technology (Isogenica) in order to control amino acid distributions. TCL23 and TCL24 gene fragments were generated using Slonomics technology (Morphosys) to control amino acid distributions. PCR was used to amplify each library following initial synthesis followed by ligation to the gene for RepA in order to be used in selections using the CIS-display system as previously described (Odegrip et al., "CIS Display: In Vitro Selection of Peptides From Libraries of Protein-DNA Complexes," *Proc. Natl. Acad. Sci. USA* 101: 2806-2810 (2004), which is hereby incorporated by reference in its entirety).

Library Screening.

Cis-display was used to select Leukotoxin binding domains from the TCL17, TCL18 and TCL19 libraries. Recombinant LukA'B toxoid complex (SEQ ID NOs:10 and 11), LukD (SEQ ID NO:12), and LukE (SEQ ID NO:13) leukotoxins were biotinylated using standard methods and used for panning Although the modified LukA'B toxoid complex was used for panning in the present Example, binding and/or neutralization of the unmodified LukAB toxin has been confirmed. For in vitro transcription and translation (ITT), 2-6 µg of library DNA were incubated with 0.1 mM complete amino acids, 1λ S30 premix components, and 30 µL of S30 extract (Promega) in a total volume of 100 µL and incubated at 30° C. After 1 hour, 450 µL of blocking solution (PBS pH 7.4, supplemented with 2% bovine serum albumin, 100 µg/mL herring sperm DNA, and 1 mg/mL heparin) were added and the reaction was incubated on ice for 15 minutes. For binding, 500 µL of blocked ITT reactions were mixed with 100 µL of biotinylated leukotoxins and incubated for 1 hour at room temperature, after which bound complexes were pulled down with magnetic neutravidin or streptavidin beads (Promega and Invitrogen). Unbound library members were removed by successive washes with PBST and PBS. After washing in rounds five, seven, and nine, DNA was eluted from the bound complexes by heating to 65° C. for 10 minutes, amplified by PCR, and attached to a DNA fragment encoding RepA by restriction digestion and ligation for further rounds of panning (this step is optional when repA is incorporated into the library). High affinity binders were isolated by successively lowering the concentration of the target leukotoxin during each round from 400 nM to 2.5 nM and increasing the washing stringency. Panning was performed through seven (LukE) and nine (LukAB and LukD) successive rounds.

Following panning, selected FN3 domains were amplified by PCR using oligos MDD40 (SEQ ID NO:8) and MDD62 (SEQ ID NO:9), subcloned into a pET vector modified to include a ligase independent cloning site, and transformed into BL21-GOLD (DE3) (Stratagene) cells for soluble expression in *E. coli* using standard molecular biology techniques. A gene sequence encoding a C-terminal polyhistidine tag was added to each FN3 domain to enable purification and detection. Cultures were grown to an optical density of 0.6-0.8 in 2YT medium supplemented with 100 µg/mL carbenicillin in 1 mL 96-well blocks at 37° C. before the addition of IPTG to 1 mM, at which point the temperature was reduced to 30° C. Cells were harvested approximately 16 hours later by centrifugation and frozen at −20° C. Cell lysis was achieved by incubating each pellet in 0.6 mL of BugBuster® HT lysis buffer (Novagen EMD Biosciences) with shaking at room temperature for 45 minutes. Antigen binding of nickel-purified FN3 domains is confirmed by ELISA.

Results

FN3 domains which bound to LukA'B (toxoid), LukD, and LukE were identified by ELISA following cis-display panning of each toxin/toxoid molecule. DNA sequences of binders were identified and unique sequences were isolated. Monomeric proteins expressed from these sequences were identified and expected molecular weights were confirmed. Antigen binding, sequence identification numbers, and monomeric FN3 domains are reported in Table 4.

TABLE 4

Characterization of FN3 domains that bind to LukAB, LukD and LukE.

| SEQ ID NO: | Description | Diversity Regions | Target |
|---|---|---|---|
| 14 | Luk17 | C, CD, F, FG | LukA'B |
| 15 | Luk19 | BC, FG | LukA'B |
| 16 | Luk20 | BC, FG | LukA'B |
| 17 | Luk24 | C, CD, F, FG | LukA'B |
| 18 | Luk8 | BC, FG | LukD |
| 19 | Luk9 | BC, FG | LukD |
| 20 | Luk10 | BC, FG | LukD |
| 21 | Luk11 | BC, FG | LukD |
| 22 | Luk12 | BC, FG | LukD |
| 23 | Luk21 | BC, FG | LukD |
| 24 | Luk22 | BC, FG | LukD |
| 25 | Luk26 | C, CD, F, FG | LukE |
| 26 | Luk27 | C, CD, F, FG | LukE |
| 27 | Luk28 | C, CD, F, FG | LukE |
| 28 | Luk29 | BC, FG | LukE |
| 29 | Luk30 | BC, FG | LukE |
| 30 | Luk31 | BC, FG | LukE |
| 31 | Luk32 | BC, FG | LukE |
| 32 | Luk33 | FG | LukE |
| 33 | Luk34 | FG | LukE |
| 34 | Luk35 | FG | LukE |
| 35 | Luk36 | FG | LukE |
| 36 | Luk37 | FG | LukE |
| 37 | Luk38 | FG | LukE |
| 38 | Luk39 | FG | LukE |
| 39 | Luk40 | FG | LukE |
| 40 | Luk41 | FG | LukE |
| 41 | Luk42 | FG | LukE |
| 42 | Luk43 | FG | LukE |
| 43 | Luk44 | FG | LukE |
| 44 | Luk45 | FG | LukE |
| 45 | Luk46 | C, CD, F, FG | LukE |
| 46 | Luk47 | C, CD, F, FG | LukE |
| 47 | Luk48 | C, CD, F, FG | LukE |
| 48 | Luk49 | C, CD, F, FG | LukE |
| 49 | Luk50 | C, CD, F, FG | LukE |
| 50 | Luk51 | C, CD, F, FG | LukE |
| 51 | Luk52 | C, CD, F, FG | LukE |
| 52 | Luk53 | C, CD, F, FG | LukE |
| 53 | Luk54 | C, CD, F, FG | LukE |
| 54 | Luk55 | C, CD, F, FG | LukE |
| 55 | Luk56 | C, CD, F, FG | LukE |
| 56 | Luk57 | C, CD, F, FG | LukE |
| 57 | Luk58 | C, CD, F, FG | LukE |
| 58 | Luk59 | C, CD, F, FG | LukE |
| 59 | Luk60 | C, CD, F, FG | LukE |

Additional FN3 domains the bind LukAB, LukD, and LukE are disclosed infra as SEQ ID NOs:113-666 in Table 6.

Summary

Cis-display panning successfully identified sequence unique, monomeric, staph leukotoxin binding FN3 domains targeted to LukA'B (4), LukD (7), and LukE (35) as detected by ELISA.

Example 2

Neutralization of Leukotoxin-Mediated Immune Cell Killing by Anti-LukD FN3 Domains To evaluate the functionality of the isolated anti-LukD FN3 domains, a cell-based cytotoxic neutralization assay was developed. Three types of FN3 domains were used, FN3 domains without linkers, and FN3 domains with the GS or the GSM linker.

Procedure

To screen the anti-LukD FN3 domains for neutralizing activity, 75 nM of LukED; a dose required to kill 100% of the cells or $LD_{100}$; was incubated for 30 minutes on ice with increasing concentrations of the different FN3 domains in a final volume of 30 µl. Freshly isolated primary human neutrophils (hPMNs), $2\times10^5$ cells in 70 µl of RPMI+10 mM HEPES+0.1% HAS, were then added to the toxin-FN3 domain mixtures. Following 1 hr incubation in a 37° C. 5% $CO_2$ incubator, 10 µl of the Cell Titer AQ ONE Solution (Promega), was added to the cells and incubated for 1 hour. Cell Titer is a colorimetric assay that evaluates cell viability by monitoring cellular metabolic activity. The colorimetric reaction was measured at 492 nm using a Perkin Elmer Envision Multilabel Reader. Percent viable cells were calculated using the following equation: % Viability=100×[($Ab_{492}$Sample−$Ab_{492}$TritonX100)/($Ab_{492}$Tissue culture media)].

Membrane damage was also measured by monitoring lactate dehydrogenase (LDH) release one hour post-incubation. 50 µl of supernatant was removed and added to wells containing 50 µl of LDH reagent (CytoTox-ONE Homogeneous Membrane Integrity Assay, Promega) and incubated for an additional 30 min at room temperature. LDH activity was measured using a Perkin Elmer Envision Multilabel Reader (Excitation 555 nm, Emission 590 nm) and data were normalized to 100% PMN lysis induced by 0.1% v/v Triton-X100.

Results

As shown in FIG. 1, the ability of selected anti-LukD FN3 domains to neutralize the cytotoxic activity of LukED towards human PMNs was assessed. Three selected anti-LukD FN3 domains; Luk10, Luk12, and Luk22; were found to block LukED-mediated killing of hPMNs. This inhibition was observed when measuring cell metabolism (Cell Titer) as well as membrane damage (LDH). In contrast to the anti-LukD FN3 domains, no neutralization was observed with the TENCON control FN3 domain.

Summary

As expected, the TENCON molecule was unable to block the cytotoxic potential of LukED In contrast, the selected anti-LukD FN3 domains neutralized LukED irrespectively of whether or not they were fused to a linker. The anti-LukD FN3 domains blocked LukED-mediated cytotoxicity in a dose-dependent manner. For illustrative purposes, the Luk12 anti-LukD FN3 domains were chosen for the generation of mAb-FN3 domain conjugates.

Example 3

Neutralization of Leukotoxin-Mediated Immune Cell Killing by Anti-LukAB FN3 Domains To evaluate the functionality of the isolated anti-LukA'B FN3 domains, a cell-based cytotoxic neutralization assay was developed and employed. Three types of FN3 domains were used, FN3 domains without linkers, and FN3 domains with the GS or the GSM linker.

Procedure

To screen the anti LukA'B FN3 domains for neutralizing activity, 18.75 nM of the active LukAB toxin ($LD_{100}$) was incubated for 30 minutes on ice with increasing concentrations of different versions of FN3 domains Luk17 (+/− linkers) in a 96-well black well clear bottom tissue culture-treated plate. $2\times10^5$ freshly isolated primary hPMNs in phenol red-free RPMI+10 mM HEPES+0.1% HSA were then added to the toxin-FN3 domain complexes and samples were incubated for one hour in a 37° C. 5% $CO_2$ incubator. Membrane damage was evaluated by two assays: ethidium bromide permeability and lactate dehydrogenase (LDH) release. Ethidium bromide permeability was measured using a Perkin Elmer Envision Multilabel Reader (Excitation 530 nm, Emission 590 nm). LDH release into the culture supernatant was also measured one hour post-incubation. 50 µl of supernatant was removed and added to wells containing 50 µl of LDH reagent (CytoTox-ONE Homogeneous Membrane Integrity Assay, Promega) and incubated for an additional 30 minutes at room temperature. LDH activity was measured using a Perkin Elmer Envision Multilabel Reader (Excitation 555 nm, Emission 590 nm) and data were normalized to 100% PMN lysis induced by 0.1% v/v Triton-X100.

Results

Figures 2A, 2B:
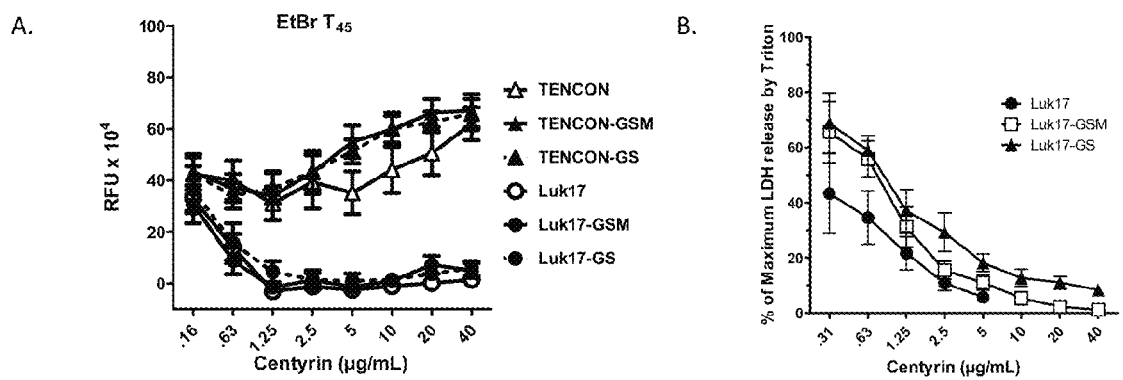
FIGS. 2A and 2B show the characterization of anti-LukAB FN3 domains. LukAB (18.8 nM) was mixed with increasing concentrations of the indicated FN3 domains for 30 minutes prior mixing with hPMNs. Cells were intoxicated for 1 hr. Data was generated from at least three independent blood donors, and error bars represent mean±SEM.

As shown in FIG. 2, the ability of the Luk17 anti-LukAB FN3 domains to neutralize the cytotoxic activity of LukAB towards human PMNs was assessed. The anti-LukAB FN3 domains were found to block LukAB-mediated killing of hPMNs as evaluated by ethidium permeability and LDH release. In contrast, no neutralization was observed with the control FN3 domain molecules.

Summary

As expected, the TENCON molecule was unable to block the cytotoxic potential of LukAB. In contrast, the anti-LukAB FN3 domains neutralized LukAB cytotoxicity irrespectively of whether or not they were fused to a linker. The anti-LukAB FN3 domains blocked LukAB-mediated cytotoxicity in a dose dependent manner. For illustrative purposes, the Luk17 anti-LukAB FN3 domain was chosen for the generation of the mAB-FN3 domain conjugates.

Example 4

Neutralization of Leukotoxin-Mediated Immune Cell Killing by Anti-LukE FN3 Domains To evaluate the functionality of the isolated anti-LukE FN3 domains, the same cell-based cytotoxic neutralization assay described for evaluation of anti-LukD FN3 domain was employed. For illustrative purposes, five anti-LukE FN3 domains were used (FN3 domains without linkers).

Procedure

To screen the anti-LukE FN3 domains for neutralizing activity, 75 nM of LukED; a dose required to kill 100% of the cells or $LD_{100}$; was incubated for 30 minutes on ice with increasing concentrations of the different FN3 domains in a final volume of 30 µl. Freshly isolated primary hPMNs, $2\times10^5$ cells in 70 µl of RPMI+10 mM HEPES+0.1% HAS, were then added to the toxin-FN3 domain mixtures. Following 1 hr incubation in a 37° C. 5% $CO_2$ incubator, cell membrane destabilization was monitored via lactate dehydrogenase (LDH) release. LDH release into the culture supernatant was measured one hour post-incubation. 50 µl of supernatant was removed and added to wells containing 50 µl of LDH reagent (CytoTox-ONE Homogeneous Membrane Integrity Assay, Promega) and incubated for an additional 30 min at room temperature. LDH activity was measured using a Perkin Elmer Envision Multilabel Reader (Excitation 555 nm, Emission 590 nm) and data were normalized to 100% PMN lysis induced by 0.1% v/v Triton-X100.

Results

Figure 3:
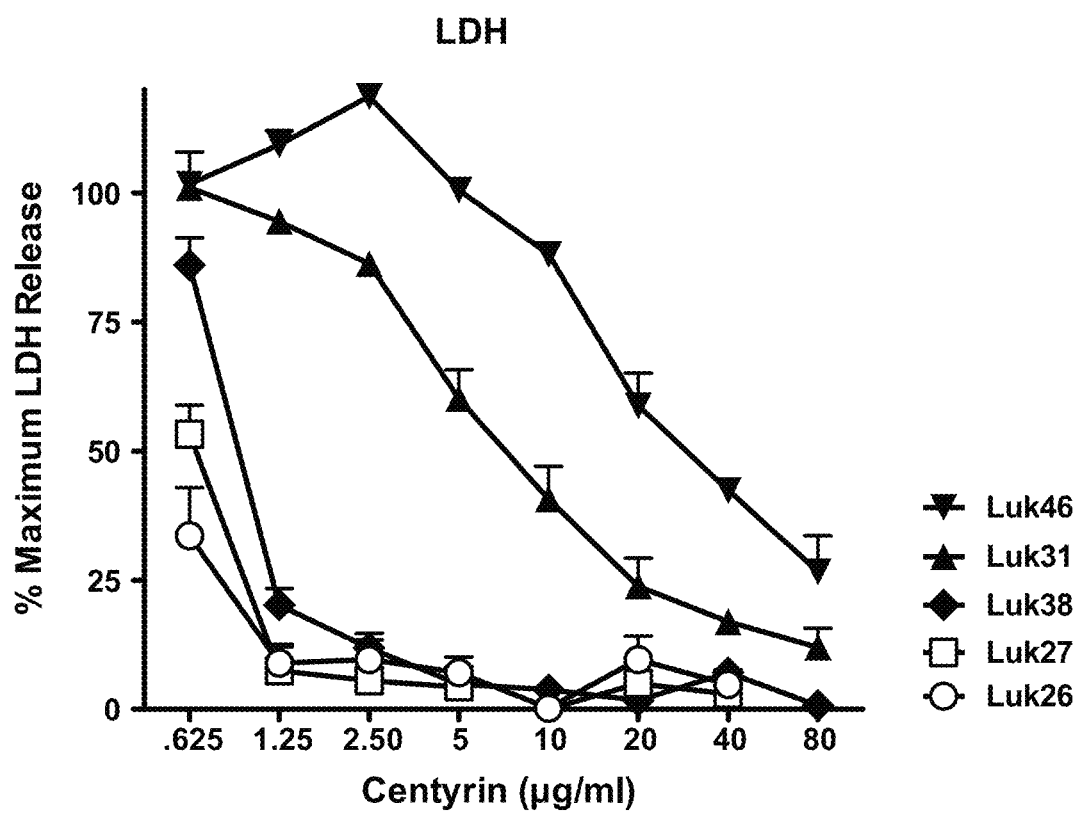
FIG. 3 shows the characterization of anti-LukE FN3 domains. LukED (75 nM) was mixed with increasing concentrations of the indicated FN3 domains for 30 minutes prior mixing with hPMNs. Cells were intoxicated for 1 hr. Data obtained from LDH measurements (membrane damage). Data was generated from at least three independent blood donors, and error bars represent mean±SEM.

The ability of selected anti-LukE FN3 domains to neutralize the cytotoxic activity of LukED towards human PMNs was assessed. All the tested anti-LukE FN3 domains were found to block LukED-mediated killing of hPMNs (FIG. 3).

Summary

LukED neutralization by the anti-LukE FN3 domains was dose dependent. Among the tested FN3 domains, anti-LukE FN3 domains Luk26, Luk27, and Luk38 exhibited the highest neutralizing activity.

Example 5

Construction of Fusion Proteins

Constructs were designed utilizing mAb 5133 (SEQ ID NOs:60 and 61), described in U.S. Pat. No. 8,460,666 to Throsby et al., which is hereby incorporated by reference in its entirety, with the intent to engage a Staph antigen via the Fab V-regions and have leukotoxin-neutralizing constructs linked to either the C-terminus of the light chain or the C-terminus of the heavy chain. Table 5 below summarizes the fusion protein constructs designed.

Figure 4A:
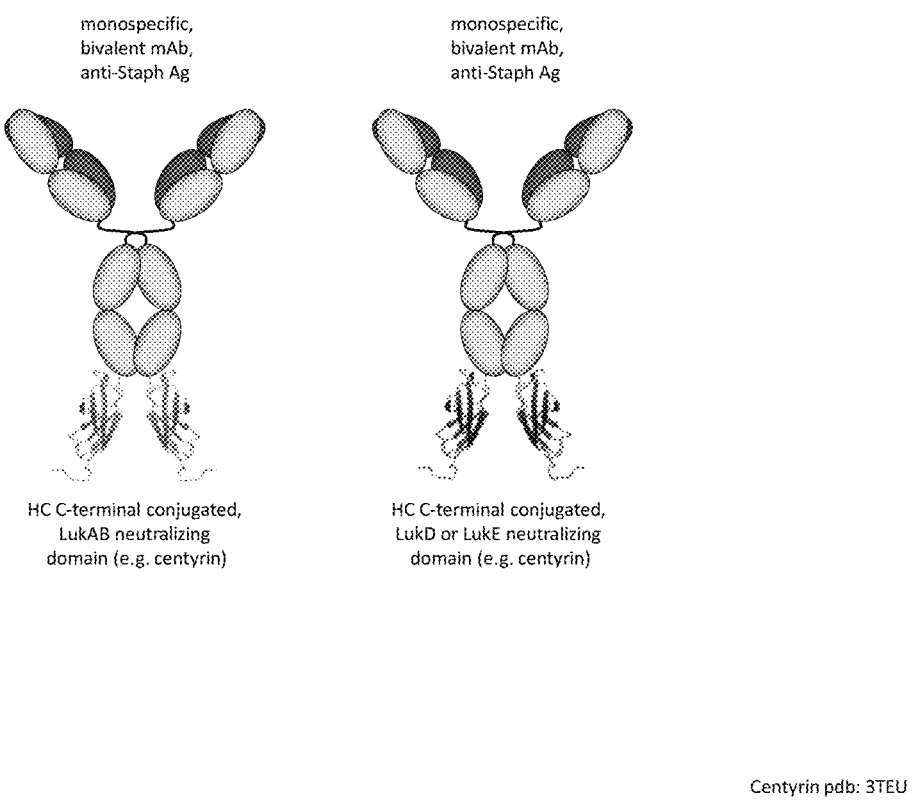

The left construct of FIG. 4A depicts a monospecific, bivalent mAb with a LukAB neutralizing construct attached to the C-terminus of each heavy chain. The right construct of FIG. 4A depicts a monospecific, bivalent mAb with a LukD or LukE neutralizing construct attached to the C-terminus of each heavy chain.

Figure 4B:
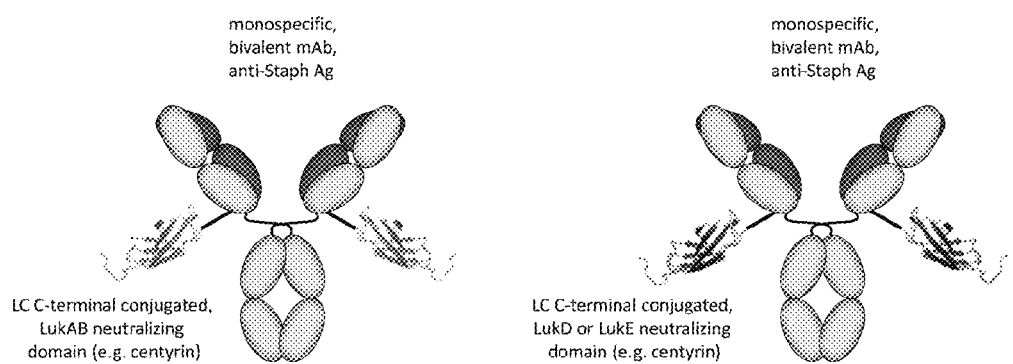

The left construct of FIG. 4B depicts a monospecific, bivalent mAb with a LukAB neutralizing construct attached to the C-terminus of each light chain. The right construct of FIG. 4B depicts a monospecific, bivalent mAb with a LukD or LukE neutralizing construct attached to the C-terminus of each light chain.

Figure 4C:
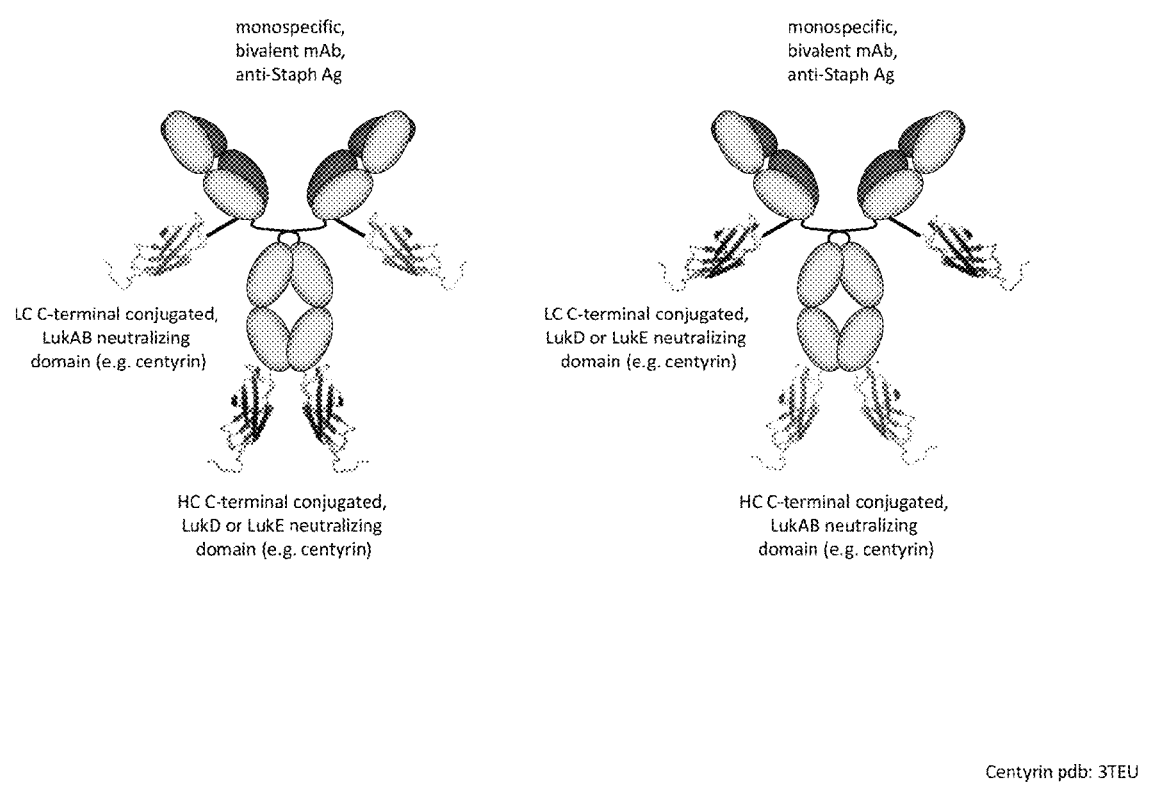

The left construct of FIG. 4C depicts a monospecific, bivalent mAb with a LukAB neutralizing construct attached to the C-terminus of each light chain, and a LukD or LukE neutralizing construct attached to the C-terminus of each heavy chain. The right construct of FIG. 4C depicts a monospecific, bivalent mAb with a LukD or LukE neutralizing construct attached to the C-terminus of each light chain and a LukAB neutralizing construct attached to the C-terminus of each heavy chain.

Figure 4D:
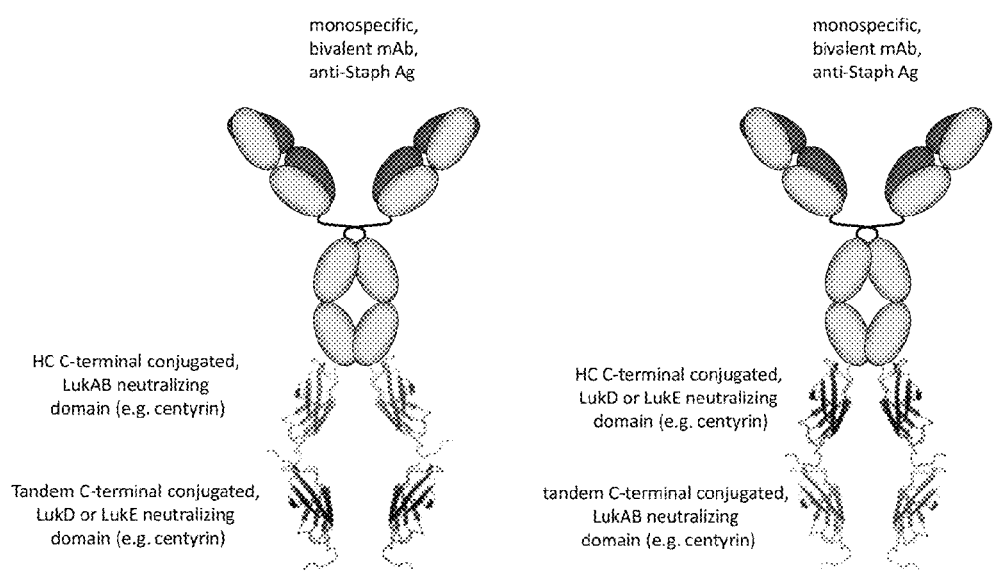

The left construct of FIG. 4D depicts a monospecific, bivalent mAb with a tandem LukAB neutralizing construct attached to the C-terminus of each heavy chain and a LukD or LukE neutralizing construct attached to the C-terminus of the LukAB neutralizing constructs. The right construct of FIG. 4D depicts a monospecific, bivalent mAb with a tandem LukD or LukE neutralizing construct attached to the C-terminus of each heavy chain and a LukAB neutralizing construct attached to the C-terminus of the LukD or LukE neutralizing constructs.

Figure 4E:
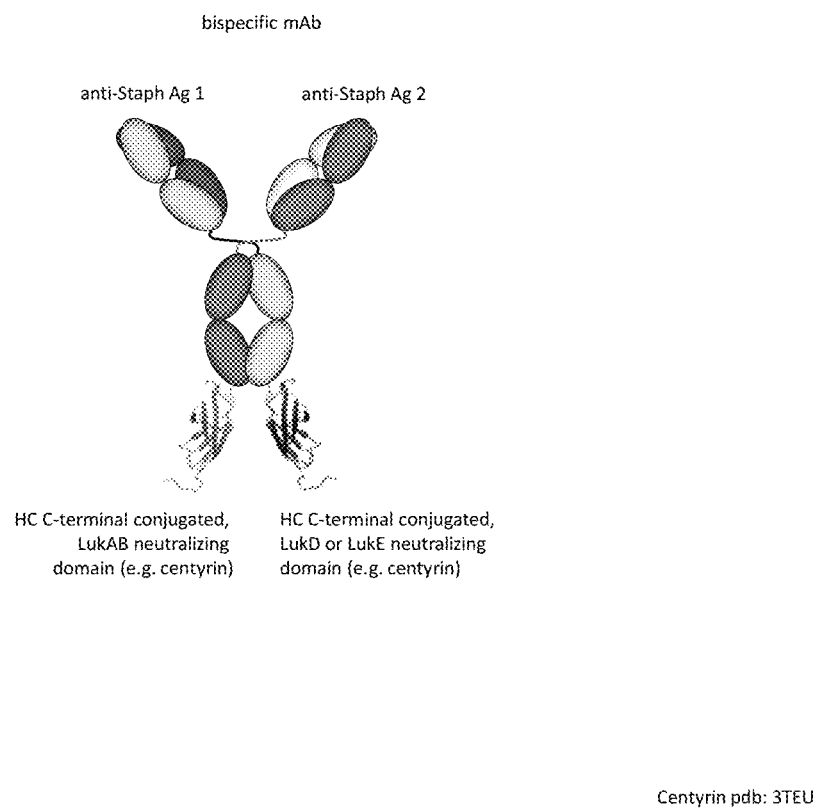

FIG. 4E depicts a bispecific, bivalent mAb with a LukD or LukE neutralizing construct attached to the C-terminus of the heavy chain recognizing Staph antigen 2, and a LukAB neutralizing construct attached to the C-terminus of the heavy chain recognizing Staph antigen 1.

Figure 4F:
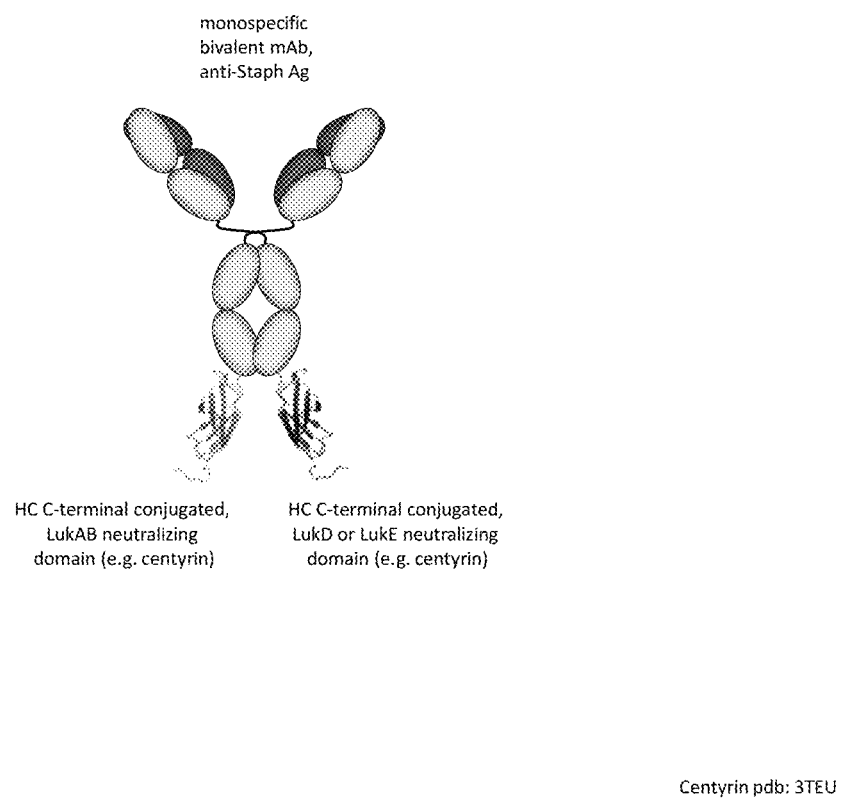

FIG. 4F depicts a monospecific, bivalent mAb with a LukAB neutralizing construct attached to the C-terminus of one heavy chain, and a LukD or LukE neutralizing construct attached to the C-terminus of the opposing heavy chain.

TABLE 5

Design of fusion protein constructs.

| Construct No. | SEQ ID NO: | Description | V-region | Heavy Chain | Heavy Chain FN3 domains | Light Chain FN3 domains |
|---|---|---|---|---|---|---|
| 1 | 60 HC 61 LC | CR5133 | anti-glycosylated SDR-containing protein | IgG1 wt | none | none |
| 2 | 62 HC 63 LC | CR5133 PRASA | anti-glycosylated SDR-containing protein | E223P/ L234V/ L235A (G236-deleted) S239D/ K326A/ E333A | none | none |
| 3 | 64 HC 65 LC | CR5133 A6 | anti-glycosylated SDR-containing protein | H435R/ Y436F | none | none |
| 4 | 66 HC 67 LC | CR5133 PRASA A6 | anti-glycosylated SDR-containing protein | E223P/ L234V/ L235A (G236-deleted) S239D/ K326A/ E333A/ H435R/ Y436F | none | none |
| 5 | 68 HC 69 LC | CR5133 PRASA A6 LC-D | anti-glycosylated SDR-containing protein | E223P/ L234V/ L235A (G236-deleted) S239D/ K326A/ E333A/ H435R/ Y436F | none | anti-LukD |
| 6 | 70 HC 71 LC | CR5133 PRASA A6 HC-AB | anti-glycosylated SDR-containing protein | E223P/ L234V/ L235A (G236-deleted) S239D/ K326A/ E333A/ H435R/ Y436F | anti-LukAB | none |
| 7 | 72 HC 73 LC | CR5133 PRASA A6 LC-D HC-AB | anti-glycosylated SDR-containing protein | E223P/ L234V/ L235A (G236-deleted) S239D/ K326A/ E333A/ H435R/ Y436F | anti-LukAB | anti-LukD |
| 8 | 74 HC 75 LC | CR5133 PRASA A6 HC-D | anti-glycosylated SDR-containing protein | E223P/ L234V/ L235A (G236-deleted) S239D/ K326A/ E333A/ H435R/ Y436F | anti-LukD | none |
| 9 | 76 HC 77 LC | CR5133 PRASA A6 HC AB-D | anti-glycosylated SDR-containing protein | E223P/ L234V/ L235A (G236-deleted) S239D/ K326A/ E333A/ H435R/ Y436F | anti-LukAB anti-LukD | none |
| 10 | 78 HC 79 LC | CR5133 PRASA A6 HC D-AB | anti-glycosylated SDR-containing protein | E223P/ L234V/ L235A (G236-deleted) S239D/ K326A/ E333A/ H435R/ Y436F | anti-LukD anti-LukAB | none |

Example 6

MAb 5133 Binds Strongly to Different Strains of *S. aureus* but does not Bind to a sdgB Mutant Strain The mAb 5133 was previously shown to bind to different strains of *S. aureus* and possess opsonophagocytic activity (described in U.S. Pat. No. 8,460,666 to Throsby et al., which is hereby incorporated by reference in its entirety). In order to further assess the specificity of the mAb 5133, western blot binding experiments were performed using different strains of *S. aureus*, as well as sub-strains from the USA300 parental JE2 strain where specific genes have been disrupted using sequence defined transposon mutants (Fey et al., "A Genetic Resource for Rapid and Comprehensive Phenotype Screening of Nonessential *Staphylococcus aureus* Genes," *mBio* 4(1):e00537-12 (2013), which is hereby incorporated by reference in its entirety) obtained from the Network on Antibiotic Resistance in *Staphylococcus aureus* (NARSA).

Procedure

For the preparation of cell lysates, the method used followed that of Brady et al., "Identification of *Staphylococcus aureus* Proteins Recognized by the Antibody-Mediated Immune Response to a Biofilm Infection," *Infect. Immun.* 74:3415-3426 (2006), which is hereby incorporated by reference in its entirety. *Staphylococcus aureus* strains were cultured in tryptic soy broth at 37° C., 190 rpm overnight. For strains carrying a transposon insertion, 10 μg/mL erythromycin was included in the culture medium. Cultures were diluted 1:100 into fresh medium and cultured for 5-6 hours, to an $OD_{600}$ of approximately 1.2. For each strain, 4.5 mL of culture were centrifuged, and the cell pellets resuspended in 75 μL of lysis buffer (50 mM Tris-HCl, 20 mM $MgCl_2$ and 10 μg/mL lysostaphin). Lysis was complete following a 20 minute incubation at 37° C. Lysates were then centrifuged at 6,000 rpm, 4° C. for 20 minutes and supernatants transferred to a new tube. For Western blot analysis, 12 μL of each lysate were heated at 70° C. for 10 minutes (LDS sample buffer with 50 mM DTT) and electrophoresed on a 10% Bis-Tris gel (Novex NuPage, Life Technologies) in MOPS buffer at 150 volts for 2 hours. The gel was blotted onto PVDF membrane using the iBlot instrument (Life Technologies) and probed with CR5133 using the FemtoMax kit (Rockland).

Results

Figure 5:
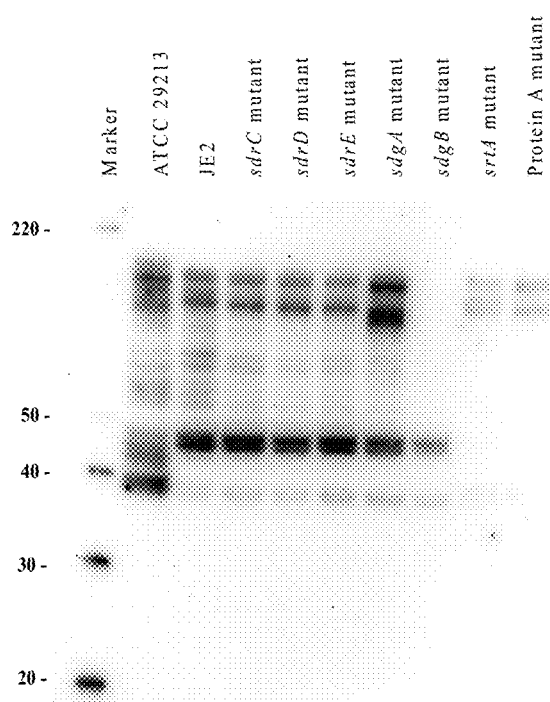
FIG. 5 shows that mAb 5133 recognizes a SdgB-glycosylated SDR protein of S. aureus. mAb 5133 does not detect high molecular weight bands in a sdgB mutant strain of S. aureus as assessed by western blotting of lysates from different S. aureus strains.

As shown in FIG. 5, mAb 5133 detected high molecular weight bands (i.e., above 50 kDa) in lysates generated from *S. aureus* strain ATCC 29213 and the parental USA300 strain JE2. High molecular weight bands were also detected with NARSA strains deficient in the serine-aspartate repeat (SDR) containing proteins SdrC, SdrD, and SdrE (lane 3 NE432 (sdrC mutant), lane 4 NE1289 (sdrD mutant), lane 5 NE98 (sdrE mutant). Faint bands were detected in the sortase mutant (lane 8 NE1787 (srtA mutant) and a protein A mutant (lane 9 NE286 (protein A mutant). High molecular weight bands were not detected in the glycosyltransferase sdgB mutant (lane 7 NE105 (sdgB mutant)) but were detected in the glycosyltransferase sdgA mutant (lane 6 NE381 (sdgA mutant)).

Summary

Serines within the SDR domain are modified by the sequential addition of N-acetylglucosamines (GlcNAc), first by SdgB followed by SdgA (Hazenbos et al., "Novel Staphylococcal Glycosyltransferases SdgA and SdgB Mediate Immunogenicity and Protection of Virulence-Associated Cell Wall Proteins," *PLoS Pathog.* 9(10):e1003653 (2013), which is hereby incorporated by reference in its entirety). The loss of detection of high molecular weight bands with mAb 5133 in lysates from the sdgB mutant is consistent with 5133 recognizing an SDR epitope that has been glycosylated by SdgB.

Example 7

V8 Proteolytic Digestion of Fusion Proteins

Human IgG1 is susceptible to cleavage in the lower hinge region, and this cleavage can result in a loss of Fc mediated effector function both in vitro and in vivo (Brerski et al., "Tumor-Associated and Microbial Proteases Compromise Host IgG Effector Functions by a Single Cleavage Proximal to the Hinge," *PNAS* 106:17864-17869 (2009), which is hereby incorporated by reference in its entirety. The *S. aureus* protease, GluV8, cleaves human IgG1 in the lower hinge region between amino acids E233 and L234, and it was previously demonstrated that this cleavage abrogates both ADCC and CDC function (Brerski et al., "Human Anti-IgG1 Hinge Autoantibodies Reconstitute the Effector Functions of Proteolytically Inactivated IgGs," *J. Immunol.* 181:3183-3192 (2008), which is hereby incorporated by reference in its entirety). In order for the mAb/FN3 domains constructs to function effectively, they must be able to both bind to a *S. aureus*-associated antigen and engage immune cell FcγRs or complement in order to facilitate phagocytosis. Proteolytic cleavage could uncouple the ability of the mAb to facilitate phagocytosis by immune effector cells. Therefore, the hinge region was engineered to have increased resistance to proteolysis by GluV8.

Procedure

The *S. aureus* protease GluV8 (cat. E-006) was obtained from BioCentrum. Antibody concentrations were fixed at 3.3 µM in PBS and reactions were initiated by the addition of GluV8 at 0.66 µM to give a 20% molar ratio for GluV8. Digestions were performed at pH 7.5 at 37° C. for 24 hours. Samples were prepared under denaturing conditions and analyzed using the Agilent 2100 microfluidics-based Bioanalyzer. The percent intact IgG was calculated based on the electropherogram profiles generated by capillary electrophoresis (Agilent Technologies) by dividing the percent intact IgG remaining in the protease digested sample by the percent intact IgG remaining in the control sample without protease. Data were analyzed and plotted using GraphPad Prism.

Results

Figure 6:
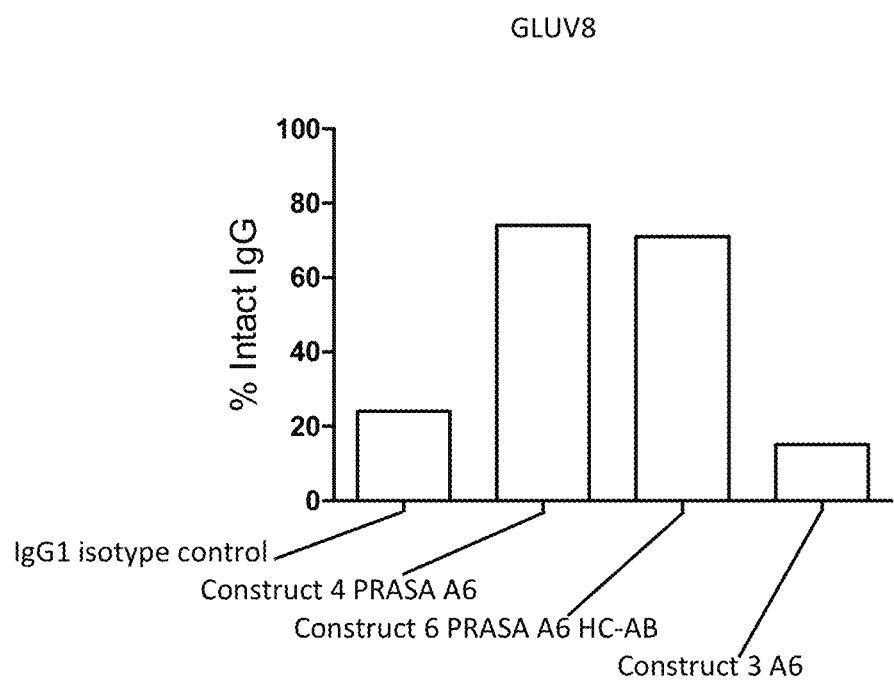
FIG. 6 shows that mutation of the lower hinge region of IgG1 conferred increased resistance to GluV8 digestion. PRASA constructs with a mutated lower hinge region, without or with a FN3 domain on the C terminus of the heavy chain (construct 4 and construct 6, respectively), are resistant to proteolysis by the S. aureus protease GluV8 compared to constructs containing the wildtype (wt) human IgG1 lower hinge region (IgG1 isotype control and construct 3).

As shown in FIG. 6, constructs IgG1 (IgG1 isotype control) and A6 (construct 3 of Table 5), which contain the lower hinge of human IgG1 wt (E233/L234/L235/G236) displayed a range of 15-25% intact IgG remaining after a 24 hour digest with GluV8. Constructs PRASA A6 (construct 4 of Table 5) and PRASA A6 HC-AB (construct 6 of Table 5), which had a mutated lower hinge (E233P/L234V/L235A with G236 deleted) displayed increased resistance to GluV8 with greater than 70% intact IgG remaining after the 24 hour GluV8 digestion.

Summary

These results indicated that mutation of the lower hinge region of IgG1 conferred increased resistance to GluV8 digestion. Further, the inclusion of the anti-LukAB FN3 domains on the C-terminus of the heavy chain did not affect susceptibility to GluV8 cleavage, because the total amount of intact IgG for the lower hinge mutated construct without the FN3 domains, PRASA A6 (construct 4), had a similar percent intact IgG remaining as the lower hinge mutated construct containing the FN3 domains, PRASA A6 HC-AB (construct 6).

Example 8

Fcγ Receptor Binding Measurements Using AlphaScreen® Competition Binding Assays

Competition ALPHASCREEN® assays were employed in order to assess the ability of anti-Staph targeting constructs to bind to FcγRs. The constructs were originally designed to bind to human FcγRs, so the constructs were tested for their ability to bind to the human activating FcγRs: FcγRI, FcγRIIa (R131), and FcγRIIIa (V158), and the inhibitory receptor, FcγRIIb.

Procedure

Figure 7A:
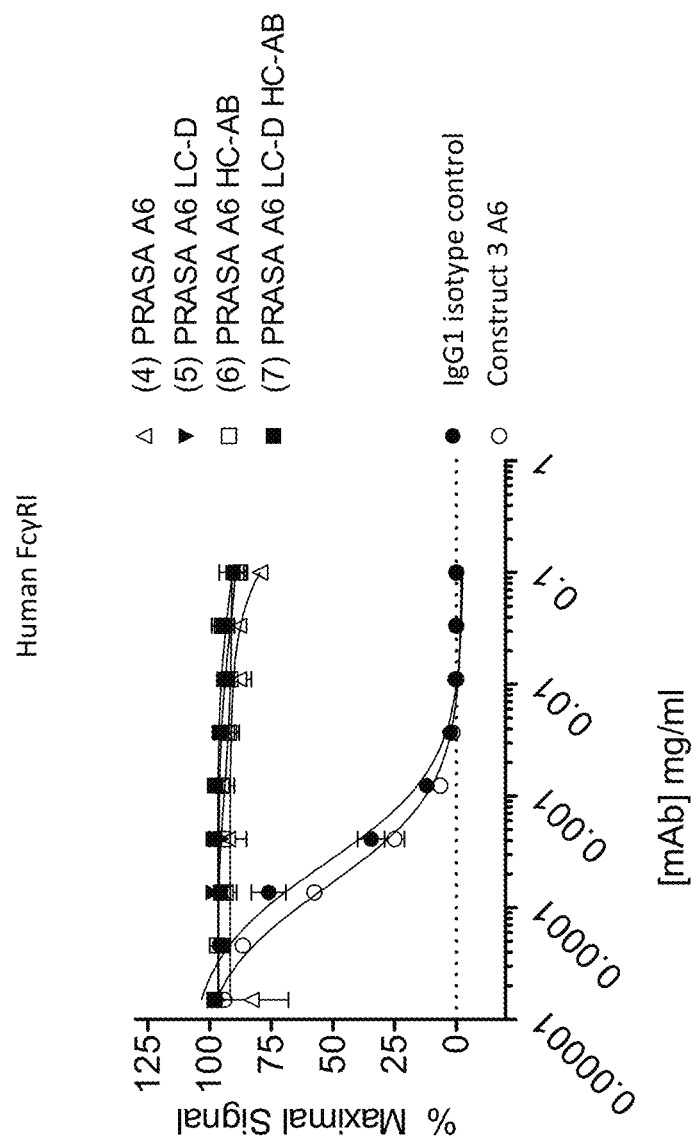
FIGS. 7A-7D show that the addition of FN3 domains does not affect PRASA variant binding to human FcγRs. Competition ALPHASCREEN® assays were employed in order to assess the ability of anti-Staph targeting constructs to bind to FcγRs. As shown in the graph of FIG. 7A, PRASA constructs (constructs 4-7) do not show detectable binding to FcγRI. All constructs (IgG1 isotype control and constructs 3-7) show similar binding to human FcγRIIa (R131) as shown in FIG. 7B. The graph of FIG. 7C shows PRASA constructs (constructs 4-7) have decreased binding to human FcγRIIb compared to IgG1 and A6 constructs (IgG1 isotype control and construct 3, respectively). As shown in the graph of FIG. 7D, all constructs (IgG1 isotype control and constructs 3-7) show similar binding to human FcγRIIIa (V158).
Figure 7B:
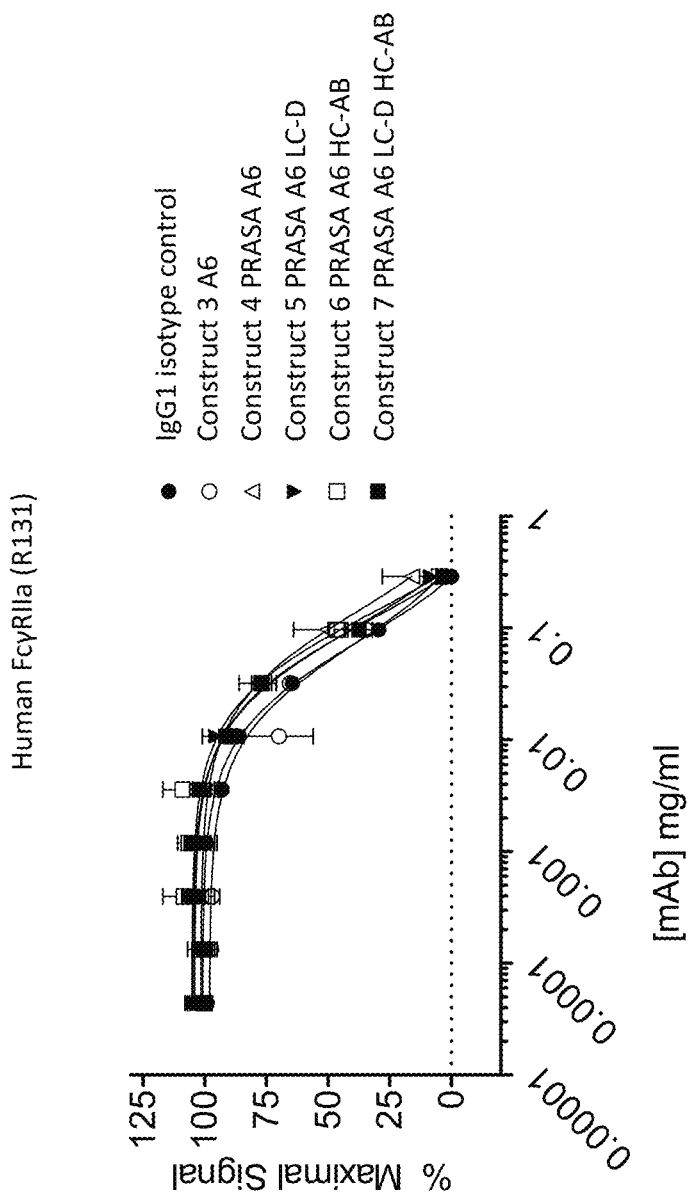
Figure 7C:
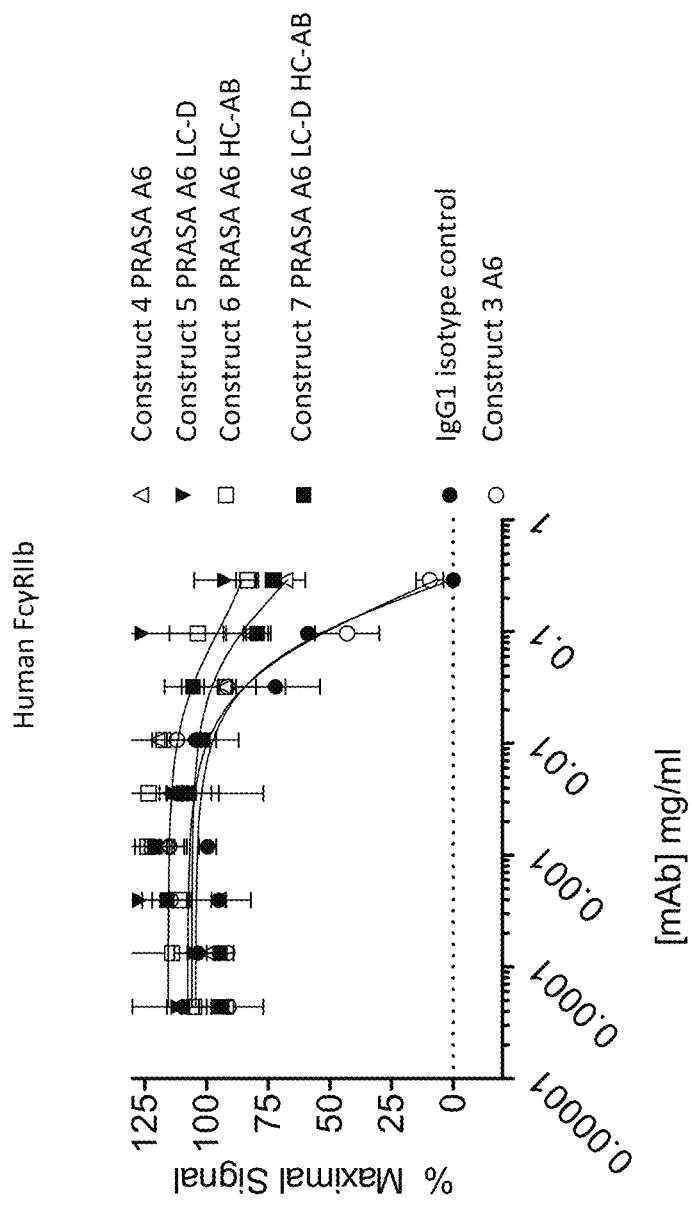
Figure 7D:
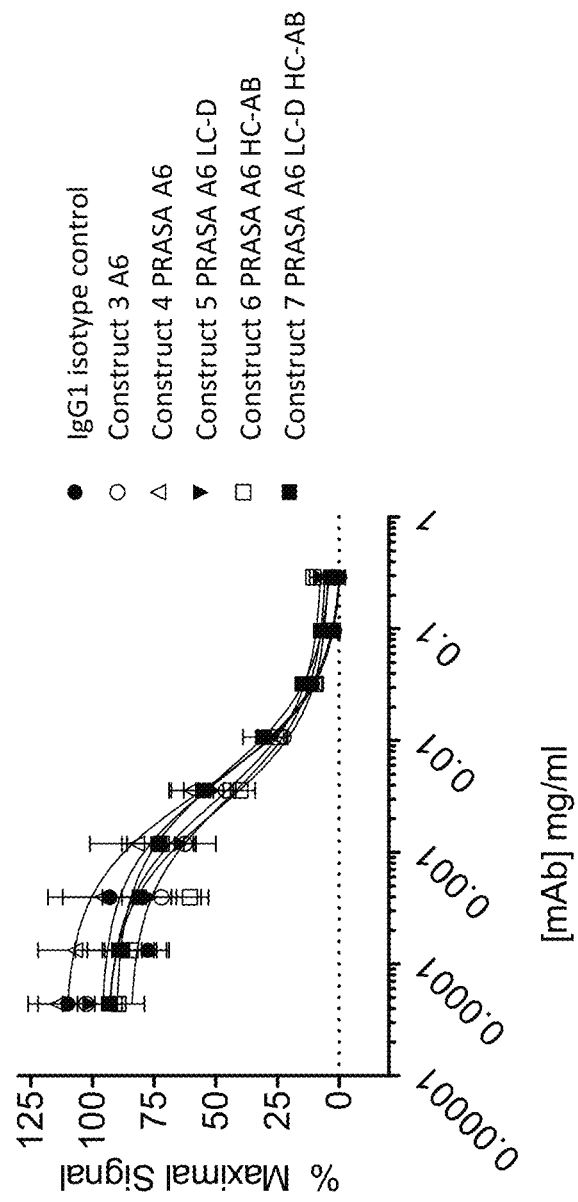

Competition binding studies were carried out in half-well volume 96-well opaque plates (Corning) in assay buffer (PBS, 0.05% BSA, 0.01% Tween-20) at pH 7.4. All competition studies were carried out against biotinylated IgG1 wild type (1 IgG: 2 biotin, using EZ Link™ NHS-LC-biotin, Pierce) at a fixed concentration and with competing IgG1 wild type and anti-Staph constructs in serial 3-fold dilutions. The final concentration of FcγR in the assays was 0.2 µg/ml. Biotinylated IgG1 (0.2 µg/ml final) and IgG1 wild type and anti-Staph constructs (10 µl) were sequentially added to each row of a 96-well plate in duplicates. Thereafter, the designated FcγRs were added followed by the sequential addition of 10 µl each of 1/50 diluted nickel chelate (Ni)-acceptor beads and 1/50 diluted streptavidin (SA)-donor beads. The opaque plate was covered with an aluminum seal to maintain light-safe conditions while shaking for 30 minutes on an Orbital shaker. Thereafter, the seal was removed and the fluorescence was read on an ENVISION™ plate reader (PerkinElmer) equipped with appropriate filter set of AlphaScreen® excitation/emission spectra. Raw data was transferred to GraphPad PRISM™ software and normalized for maximal signal and competition curves were plotted using non-linear regression curve-fitting software. The competition binding curves were generated using the following equation: % Maximal Signal=(Exp−Min)/(Max−Min)×100% where the minimum (Min) was determined by signal detected in the presence of the highest concentration of test article mAb and the maximum (Max) was determined by the signal detected in wells that only contained the biotinylated IgG1, FcγR, nickel chelate (Ni)-acceptor beads and streptavidin (SA)-donor beads without any of the anti-Staph constructs.
Results The ability of several of the constructs to compete for binding to the human Fc gamma family of receptors with human IgG1 wild type was assessed. The ability of the constructs to reduce maximum signal produced by the biotinylated IgG1 wild type are shown in FIGS. 7A through 7D. As shown in FIG. 7A, the IgG1 (IgG1 isotype control) and A6 (construct 3) bound robustly to human FcγRI. The constructs PRASA A6 (construct 4), PRASA A6 LC-D (construct 5), PRASA A6 HC-AB (construct 6), and PRASA A6 LC-D HC-AB (construct 7) did not display binding to human FcγRI at any of the concentration tested. The constructs IgG1 (IgG1 isotype control), A6 (construct 3), PRASA A6 (construct 4), PRASA A6 LC-D (construct 5), PRASA A6 HC-AB (construct 6), and PRASA A6 LC-D HC-AB (construct 7) all displayed comparable binding to human FcγRIIa (R131) (FIG. 7B). The constructs IgG1 (IgG1 isotype control) and A6 (construct 3) displayed the highest binding to the inhibitory human FcγRIIb, whereas the constructs PRASA A6 (construct 4), PRASA A6 LC-D (construct 5), PRASA A6 HC-AB (construct 6), and PRASA A6 LC-D HC-AB (construct 7) displayed low to undetectable binding (FIG. 7C). The constructs IgG1 (IgG1 isotype control), A6 (construct 3), PRASA A6 (construct 4), PRASA A6 LC-D (construct 5), PRASA A6 HC-AB (construct 6), and PRASA A6 LC-D HC-AB (construct 7) all displayed comparable binding to human FcγRIIIa (V158) (FIG. 7D).
Summary None of the constructs with the lower hinge mutations (E233P, L234V, L235A with G236-deleted) displayed binding to human FcγRI (see US Patent Publ. No. 2013/0011386 A1), and the inclusion of either a C-terminal FN3 domains on either the heavy or light chain did not affect binding. All constructs displayed comparable binding to activating human FcγRIIa (R131) and FcγRIIIa (V158), which indicated that the inclusion of the FN3 domains did not affect binding to these receptors. The constructs PRASA A6 (4), PRASA A6 LC-D (5), PRASA A6 HC-AB (6), and PRASA A6 LC-D HC-AB (7) displayed low to undetectable binding to the inhibitory receptor FcγRIIb. This could be advantageous since the low binding to human FcγRIIb and normal binding to the activating receptors FcγRIIa and FcγRIIIa would increase the activating (A) to inhibitory (I) index, a property that is thought to increase the efficacy of mAbs with an intended cytotoxic mechanism of action (Nimmerjahn and Ravetch, "Divergent Immunoglobulin g Subclass Activity Through Selective Fc Receptor Binding," *Science* 310: 1510-1512 (2005), which is hereby incorporated by reference in its entirety).

Example 9

Protein A Binding Measurements

Figure 8:
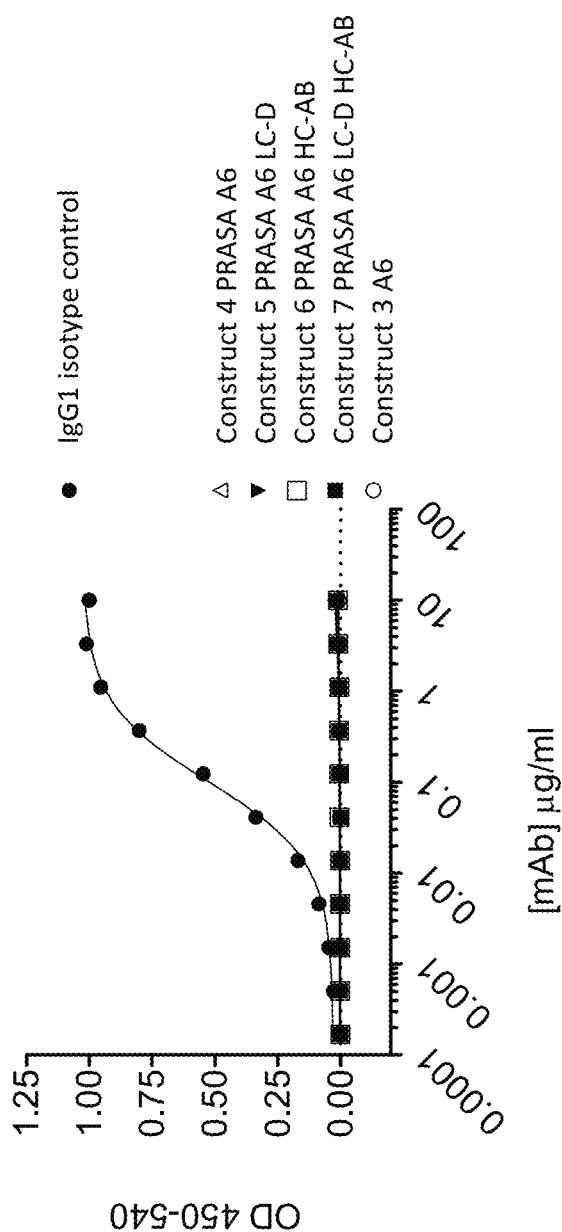
FIG. 8 shows that the CH3 mutations H435R/Y436F reduced and/or eliminated Protein A binding, as determined using direct Protein A ELISA assays. PRASA A6 variants (constructs 4-7) do not show detectable binding to Protein A in a plate-based ELISA assay, whereas human IgG1 (IgG1 isotype control) binds to Protein A.

Plate-based ELISA assays were employed in order to assess the binding of the constructs to Protein A coated onto an ELISA plate. Protein A is a Staph virulence factor, and human IgG1 wildtype antibodies are sequestered on the surface of Staph via binding to the Fc of IgG1 wildtype. This process is thought to abrogate the ability of anti-Staph mAbs to bind to surface determinants through the antibody V-region and simultaneously block Fc interactions with humoral and cellular components of the host immune system. In order to circumvent this Staph virulence factor, constructs were engineered with the intent to remove Protein A binding.
Procedure Direct Protein A binding ELISAs were carried out in clear 96-well plates (Nunc) in ELISA blocking buffer (3% Bovine Serum Albumin in PBS). Biotinylated Protein A was coated in the 96-well plates at 2 µg/ml in PBS for 1 hour at room temperature, washed 3 times in ELISA wash buffer (0.15 M NaCl with 0.02% Tween-20). Plates were then blocked with ELISA blocking buffer for 1 hour at room temperature. Plates were then washed 3 times in ELISA wash buffer. Constructs were applied to the plate with a starting concentration of 10 µg/ml, then were serially diluted 3-fold across the plate and incubated for 1 hour at room temperature. Plates were washed 3 times with ELISA wash buffer. Constructs were detected with a horse radish peroxidase (HRP) conjugated goat anti-human kappa light chain antibody (Millipore) diluted 1:15,000 in ELISA blocking buffer and samples were incubated for 30 minutes at room temperature. Plates were washed 5 times with ELISA wash buffer. The substrate for HRP in this assay was TMB (Fitzgerald), and plates were incubated until to wells turned blue. The reaction was stopped by adding and equal volume of 0.5 M HCl to the TMB, and plates were read at 450 nm. Data were analyzed with Graph Pad Prism software using non-linear regression curve-fits.
Results The human IgG1 wild type construct (construct 1) displayed detectable binding to Protein A. All of the constructs which contained the CH3 mutation H435R/Y436F (i.e., A6 (construct 3), PRASA A6 (construct 4), PRASA A6 LC-D (construct 5), PRASA A6 HC-AB (construct 6), and PRASA A6 LC-D HC-AB (construct 7) did not display detectable binding to Protein A at any of the concentrations tested (FIG. 8).
Summary The CH3 mutations H435R/Y436F successfully eliminated Protein A binding, as assessed in this assay. The inclusion of FN3 domains on either the C-terminus of the heavy chain or the light chain did not affect Protein A binding.

Example 10

Binding to Whole Bacteria as Measured by Flow Cytometry

Binding of mAb and FN3 domain-mAb conjugates to the surface of the Newman Strain of *S. aureus* was assessed using flow cytometric analysis. Because the *S. aureus* virulence factor Protein A can bind to IgG1 via the Fc portion of the antibody and can confound analysis, antibodies with the H435R/Y436F mutations, designated A6, were used to eliminate non-specific binding of the Fc region of the mAbs to Protein A expressed on the surface of the Staph (see Example 9). Therefore, A6 (construct 3), PRASA A6 (construct 4) and mAb-FN3 domain conjugates each containing the H435R/Y436F mutations were compared. A construct with V-regions specific for lipoteichoic acid (LTA) containing the constant region mutations of E233P/L234V/L235A (G236-deleted) H435R/Y436F (termed "PRASA A6 isotype control") was used as a negative control as the binding of this construct was low/negative for the *S. aureus* strain selected.
Procedure The *S. aureus* Newman strain was grown at 37° C. with shaking at 225 rpm in brain heart infusion (BHI) modified broth until the cultures reached an OD 600 nM of approximately 0.5. Aliquots were frozen in cryovials with 10% glycerol (final). A vial was thawed and used to determine colony forming units by serial dilution and growth on BHI agar plates. For flow cytometric analysis, Newman strain was plated at $5 \times 10^6$ colony forming units per well and incubated with the indicated serial dilutions of mAb 5133 constructs for 30 minutes at room temperature in FACS buffer. Samples were washed twice with FACS buffer, prior to staining with 20 µg/ml Alexa647 conjugated F(ab')$_2$ goat anti-human IgG (heavy and light) to detect the constructs. Samples were analyzed using a BD Fortessa and Flowjo software. These experiments were repeated twice with similar results.

Results

Figure 9:
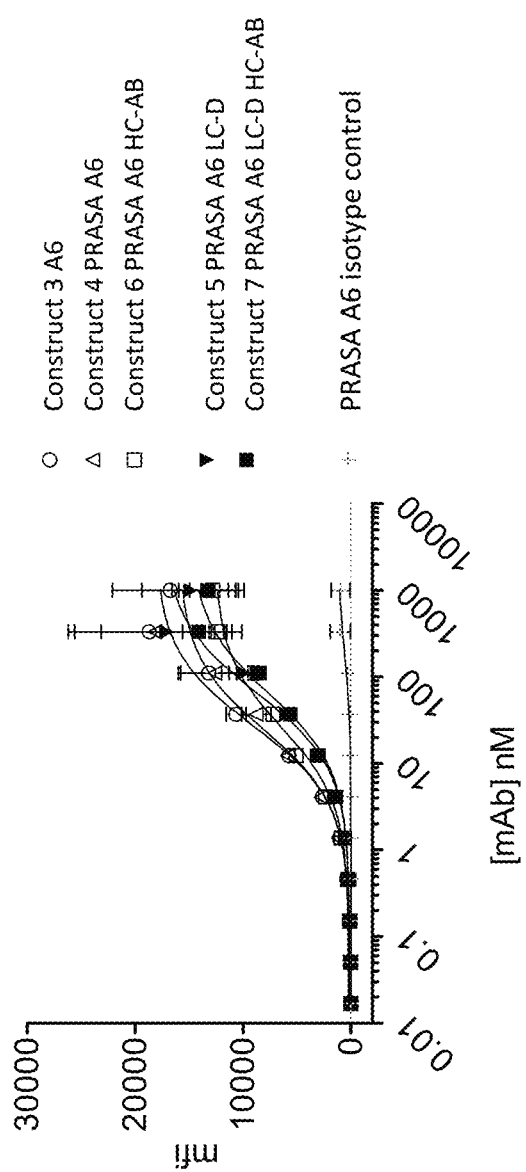
FIG. 9 shows that mAb-FN3 domain binding conjugates are capable of binding to S. aureus (Newman strain) in a flow cytometry-based binding assay.
Figures 10A, 10B:
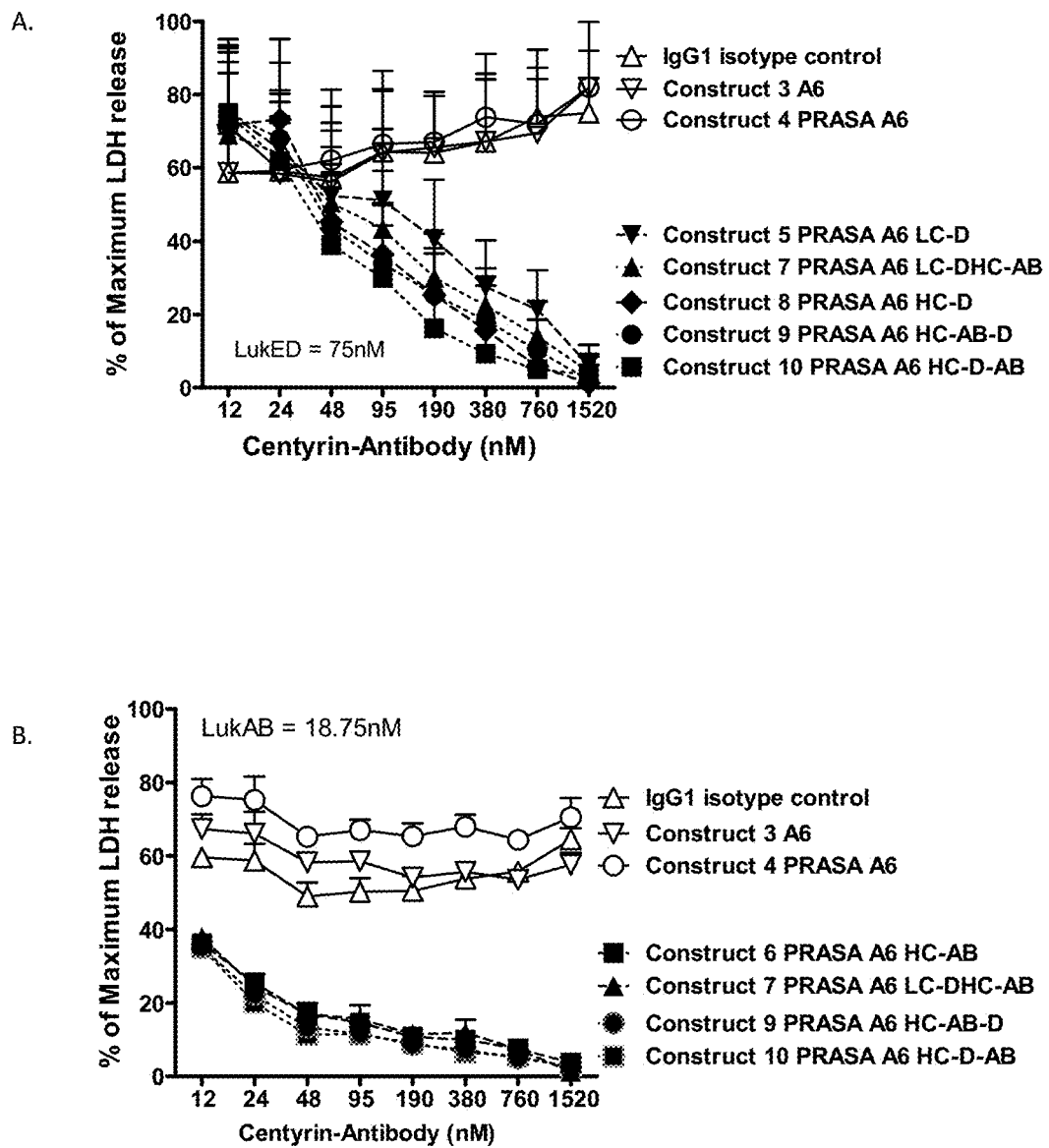
FIGS. 10A-10B show the characterization of the mAb-FN3 domain conjugates. LDH measurements (membrane damage) were taken from at least three independent blood donors, and error bars represent mean±SEM. The graph of FIG. 10A shows LDH release from hPMNs after exposure to LukED (75 nM) that was mixed with increasing concentrations of the indicated mAbs or FN3 domain-mAb conjugates for 30 minutes prior to cell exposure. Cells were intoxicated for 1 hr. The graph of FIG. 10B shows LDH release from hPMNs after exposure to LukAB (18.8 nM) that was mixed with increasing concentrations of the indicated mAbs or mAb-FN3 domain conjugates for 30 minutes prior mixing with hPMNs. Cells were intoxicated for 1 hr.

As shown in FIG. 9, as assessed by flow cytometry binding, the constructs A6 (construct 3), PRASA A6 (construct 4), and PRASA A6 HC-AB (construct 6) had similar binding to the Newman *S. aureus* strain. Addition of an anti-LukD FN3 domain to the light chain resulted in an approximately 2 to 3-fold decrease in binding for constructs PRASA A6 LC-D (construct 5) and PRASA A6 LC-D HC-AB (construct 7) compared to than the same antibody without FN3 domain conjugates (calculated by EC50 test mAb/EC50 PRASA A6 (construct 4)).

Summary

Figure 11:
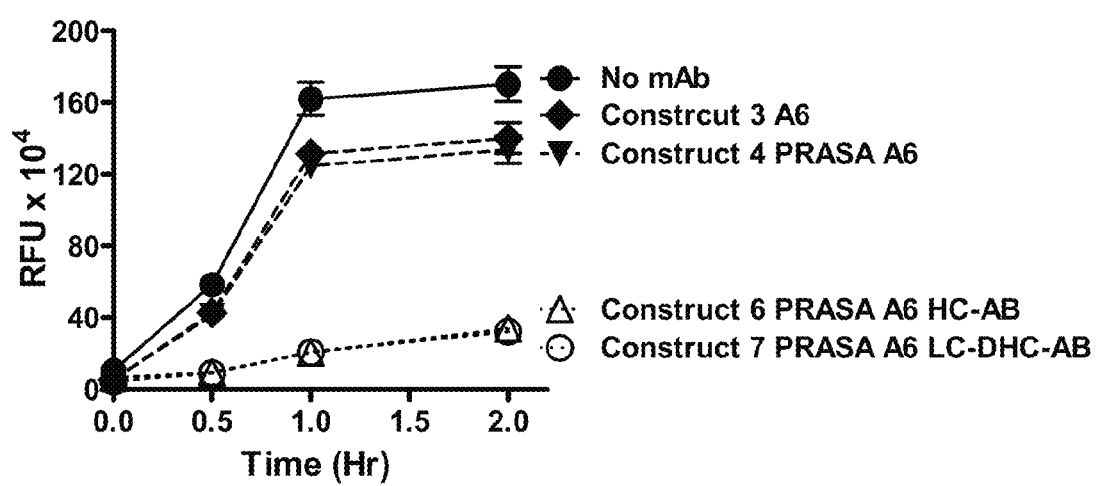
FIG. 11 shows that Staph LukAB-mediated cytotoxicity post-phagocytosis can be neutralized by the mAb-FN3 domain conjugates. Primary human PMNs were infected with Staph previously opsonized with different mAb 5133 antibodies or without antibodies. Opsonized bacteria were used to infect hPMNs at an MOI of 10 in the presence of ethidium bromide. The ability of Staph to induce membrane damage was evaluated by measuring ethidium bromide permeability over 2 hrs. Data was generated from at least three independent blood donors, and error bars represent mean±SEM.

Addition of anti-LukAB to the heavy chain did not impact antibody binding to *S. aureus*, whereas the addition of the anti-LukD FN3 domain to the C-terminus of the light chain resulted in slightly decreased detection of binding to the *S. aureus* Newman strain (2 to 3-fold change in EC50 in two independent experiments).

Example 11

Neutralization of Leukotoxin-Mediated Immune Cell Killing by mAb-FN3 Domain Conjugates To evaluate the functionality of the mAb-FN3 domain 5133 conjugates, the cell-based cytotoxic neutralization assay described for evaluation of neutralization of LukED and LukAB were employed.

Procedure

To screen the mAb-FN3 domain 5133 conjugates for LukED and LukAB neutralizing activity, 75 nM of LukED and 18.75 nM of active LukAB toxin were independently incubated for 30 minutes on ice with increasing concentrations of the different mAb variants (IgG1 isotype control; A6 construct 3; PRASA A6 construct 4); PRASA A6 LC-D construct 5; PRASA A6 HC-D construct 8; PRASA A6 HC-AB construct 6; PRASA A6 LC-D HC-AB construct 7; PRASA A6 HC AB-D construct 9; and PRASA A6 HC D-AB construct 10) in a final volume of 30 μl. Freshly isolated primary human neutrophils (hPMNs); $2\times10^5$ cells in 70 μl of RPMI+10 mM HEPES+0.1% HAS were then added to the toxin-mAb mixtures and incubated for 1 hour in a 37° C. 5% $CO_2$ incubator. Membrane damage was measured by monitoring lactate dehydrogenase (LDH) release one hour post-incubation. 50 μl of supernatant was removed and added to wells containing 50 μl of LDH reagent (CytoTox-ONE Homogeneous Membrane Integrity Assay, Promega) and incubated for an additional 30 min at room temperature. LDH activity was measured using a Perkin Elmer Envision Multilabel Reader (Excitation 555 nm, Emission 590 nm) and data were normalized to 100% PMN lysis induced by 0.1% v/v Triton-X100.

Results

The ability of different mAb 5133 and the mAb-FN3 domain 5133 conjugates to neutralize the cytotoxic activity of LukED and LukAB towards human PMNs was assessed. These studies demonstrate that the FN3 domain-mAb conjugates with the LukD (PRASA A6 LC-D construct 5 and PRASA A6 HC-D construct 8) or anti-LukAB FN3 domain (PRASA A6 HC-AB construct 6) were able to neutralize the respective toxin irrespectively if the FN3 domains were appended to the light of heavy chain (PRASA A6 LC-D construct 5 vs. PRASA A6 HC-D construct 8) (FIG. 10A). Moreover, simultaneous conjugation of both the LukD and LukAB FN3 domains to the mAb 5133 (PRASA A6 LC-D HC-AB construct 7, PRASA A6 HC AB-D construct 9, and PRASA A6 HC D-AB construct 10) (FIGS. 10A-10B) also resulted in potent neutralization of the respective toxin.

Summary

These studies show that only the FN3 domain-mAb conjugates are capable of blocking LukED and LukAB killing of primary hPMNs, but not the IgG1 isotype control, A6 construct 3, or PRASA A6 construct 4 mAbs. Taken together, these data establish that the mAb-FN3 domain conjugates are functional and can block the cytotoxic activity of potent Staph toxins.

Example 12

Neutralizing Effects of the mAb-FN3 Domain Conjugates in a Model of *S. aureus*-Mediated Killing of Human Neutrophils Post-Phagocytosis Among the bi-component toxins produced by Staph, LukAB is responsible for killing human neutrophils (hPMNs) during ex vivo infection with live bacteria. Staph-produced LukAB kills hPMNs by targeting the plasma membrane or the phagosomal membrane post-phagocytosis. To evaluate if the mAb-FN3 domain conjugates protect hPMNs from LukAB-mediated killing post-phagocytosis of live Staph, an ex vivo infection model was developed.

Procedure

Staph strain Newman, a highly virulent methicillin sensitive strain, was subcultured 1:100 in RPMI+CAS for 5 hours and normalized to $1\times10^7$ CFU/mL in RPMI supplemented with 10 mM HEPES and 0.1% HSA (RPMI-HH). Aliquots of 1 mL of the normalized bacteria were pelleted by centrifugation and resuspended in 300 μl of different mAb 5133 or mAb-FN3 domain conjugates at 1.5 mg/ml, or PBS (non-opsonized). Samples were brought up to 1 mL with RPMI-HH and then incubated for 20 minutes at 37° C. for opsonization. The opsonized bacteria were subsequently mixed with $2\times10^5$ freshly isolated primary hPMNs in RPMI-HH supplemented with EtBr at a multiplicity of infection (MOI) of ~10:1 (bacteria:hPMN). Bacteria and cells were synchronized by centrifugation at 1500 RPM for 7 minutes and placed in a 37° C. 5% $CO_2$ incubator. Ethidium bromide fluorescence, as an indicator of hPMN membrane permeability, was measured during a two hour infection.

Results

The ability of different mAb 5133 and the mAb-FN3 domain 5133 conjugates to neutralize the cytotoxic activity of LukAB protecting hPMNs post Staph phagocytosis was assessed. These experiments demonstrate that the A6 construct 3 and the PRASA A6 construct 4 mAb confer minimal protection to hPMNs from *S. aureus*-mediated killing compared to PBS treated bacteria (no mAb). In contrast, both of the mAb-FN3 domain conjugates tested, PRASA A6 HC-AB construct 6 and PRASA A6 LC-D AB construct 7, protected hPMNs from LukAB-mediated membrane damage post-phagocytosis. No notable difference was observed between the mAb-FN3 domain conjugate containing only the anti-LukAB FN3 domains compared to that of the conjugate containing both the anti-LukAB and the anti-LukD FN3 domains (FIG. 11). This finding is consistent with the lack of LukED production during ex vivo infection models (DuMont et al., "Characterization of a New Cytotoxin That Contributes to Staphylococcus aureus Pathogenesis," Mol. Microbiol. 79:814-825 (2011); Alonzo et al., "Staphylococcus aureus Leucocidin ED Contributes to Systemic Infection by Targeting Neutrophils and Promoting Bacterial Growth In Vivo," Mol. Microbiol. 83:423-435 (2012); DuMont et al., "Staphylococcus aureus Elaborates Leukocidin AB to Mediate Escape From Within Human Neutrophils," Infect. Immun. 81:1830-1841 (2013), all of which are hereby incorporated by reference in their entirety).

Summary

These experiments establish that the Staph LukAB-mediated cytotoxicity post-phagocytosis could be neutralized from within the cell by the mAb-FN3 domain conjugates.

Example 13

Neutralizing Effects of the mAb-FN3 Domain Conjugates in a Model of Neutrophil-Mediated Killing of S. aureus LukAB kills hPMNs post-phagocytosis and promotes Staph escape and growth (DuMont et al., "Characterization of a New Cytotoxin That Contributes to Staphylococcus aureus Pathogenesis," Mol. Microbiol. 79:814-825 (2011); DuMont et al., "Staphylococcus aureus Elaborates Leukocidin AB to Mediate Escape From Within Human Neutrophils," Infect. Immun. 81:1830-1841 (2013); DuMont et al., "Staphylococcus aureus LukAB Cytotoxin Kills Human Neutrophils by Targeting the CD11b Subunit of the Integrin Mac-1," Proc. Natl. Acad. Sci. USA 110:10794-10799 (2013), all of which are hereby incorporated by reference in their entirety). Infection of hPMNs with isogenic deletion mutant strains lacking lukAB have suggested that blocking LukAB activity diminishes bacterial growth in ex vivo OPK assays (DuMont et al., "Characterization of a New Cytotoxin That Contributes to Staphylococcus aureus Pathogenesis," Mol. Microbiol. 79:814-825 (2011); DuMont et al., "Staphylococcus aureus Elaborates Leukocidin AB to Mediate Escape From Within Human Neutrophils," Infect. Immun. 81:1830-1841 (2013); DuMont et al., "Staphylococcus aureus LukAB Cytotoxin Kills Human Neutrophils by Targeting the CD11b Subunit of the Integrin Mac-1," Proc. Natl. Acad. Sci. USA 110:10794-10799 (2013), all of which are hereby incorporated by reference in their entirety). To investigate if the LukAB mAb-FN3 domain conjugates promote hPMN-mediated control of S. aureus growth; an OPK assay was implemented where bacterial growth was monitored by measuring GFP fluorescence.

Procedure

For these experiments the Staph strain Newman (MSSA) that contains a plasmid that expresses the green fluorescent protein (gfp) constitutively by using the sarA promoter was employed. The GFP-labeled bacteria was subcultured 1:100 in RPMI+CAS supplemented with chloramphenicol for 5 hours and normalized to $1 \times 10^7$ CFU/mL in RPMI supplemented with 10 mM HEPES and 0.1% HSA (RPMI-HH). Aliquots of 1 mL of the normalized bacteria were pelleted by centrifugation and resuspended in 300 µl of different mAb or mAb-FN3 domain conjugates at 1.5 mg/ml, or PBS (non-opsonized). Samples were brought up to 1 mL with RPMI-HH and then incubated for 20 minutes at 37° C. for opsonization. The opsonized bacteria were subsequently mixed with $2 \times 10^5$ freshly isolated primary hPMNs in RPMI-HH at a multiplicity of infection (MOI) of ~10:1 (bacteria: hPMN). Bacteria and cells were synchronized by centrifugation at 1500 RPM for 7 minutes and placed in a 37° C. 5% $CO_2$ incubator. GFP fluorescence, as an indicator of bacterial growth was measured 5 hours post-infection.

Results

Figure 12:
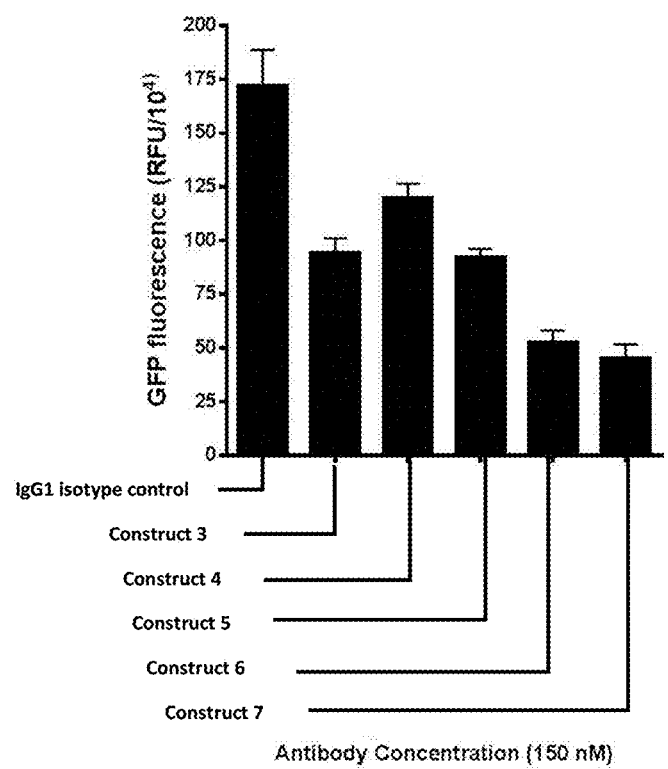
FIG. 12 shows that mAb-FN3 domain fusion proteins bearing anti-LukAB FN3 domains neutralize leukotoxin LukAB and promote human polymorphonuclear neutrophil (PMN) mediated restriction of the growth of *S. aureus*. These experiments employed a variant of *S. aureus* strain Newman that harbors a plasmid that expresses the green fluorescent protein (gfp). Freshly grown GFP-labeled bacteria were normalized to $1\times10^7$ CFU/mL and 1 mL aliquots pelleted by centrifugation and re-suspended in 300 µl of different mAb or mAb-FN3 fusion proteins at 1.5 mg/mL, or PBS (non-opsonized). Samples were brought up to 1 mL with RPMI-HH and then incubated for 20 minutes at 37° C. for opsonization. The opsonized bacteria were subsequently mixed with $2\times10^5$ freshly isolated primary hPMNs at a multiplicity of infection (MOI) of ~10:1 (bacteria:hPMN). Bacteria and cells were synchronized by centrifugation at 1500 RPM for 7 minutes and placed in a 37° C. 5% CO2 incubator. GFP fluorescence, as an indicator of bacterial growth was measured 5 hours post-infection.

The ability of different mAb 5133 and the mAb-FN3 domain5133 conjugates to promote hPMN-mediated growth restriction of Staph was assessed. These experiments demonstrate that in comparison to the IgG1 isotype control, both A6 construct 3 and PRASA A6 construct 4 promote hPMN-mediated S. aureus growth-restriction (FIG. 12). This is consistent with the opsonic capability of the 5133 mAb. Importantly, the LukAB FN3 domain-mAb 5133 conjugates (PRASA A6 HC-AB construct 6 and PRASA A6 LC-D HC-AB construct 7) enhanced PMN-mediated growth restriction compared to the PRASA A6 parental mAb (construct 4) (FIG. 12). The lack of enhancement in growth restriction by the CR5133/anti-LukD FN3 domain-mAbs (PRASA A6 LC-D construct 5) is consistent with previous findings that LukED production is minimal during ex vivo infection models (DuMont et al., "Characterization of a New Cytotoxin That Contributes to Staphylococcus aureus Pathogenesis," Mol. Microbiol. 79:814-825 (2011); Alonzo et al., "Staphylococcus aureus Leucocidin ED Contributes to Systemic Infection by Targeting Neutrophils and Promoting Bacterial Growth In Vivo," Mol. Microbiol. 83:423-435 (2012); DuMont et al., "Staphylococcus aureus Elaborates Leukocidin AB to Mediate Escape From Within Human Neutrophils," Infect. Immun. 81:1830-1841 (2013), all of which are hereby incorporated by reference in their entirety).

Summary

These experiments establish that the anti-LukAB mAb-FN3 domain conjugates neutralize LukAB, promoting hPMN-mediated Staph growth-restriction.

Example 14

In Vitro Glycosylation of Ni-NTA Resin-Bound SdrC4 Protein with S. aureus Cell Lysates Results in an Epitope Recognized by mAb 5133

In order to further validate that SdgB-mediated glycosylation of SDR-containing proteins results in creation of a specific epitope recognized by mAb 5133, in vitro glycosylation of a representative SDR protein (recombinant SdrC4 protein purified from E. coli) was undertaken using cell lysates prepared from different S. aureus strains and the reaction products separated by SDS-PAGE and analyzed by Western blot analysis. These studies employed the USA300 parental JE2 S. aureus strain and mutants with transposon insertions that inactivate either the sdgA or sdgB glycosyltransferases (Fey et al., "A Genetic Resource for Rapid and Comprehensive Phenotype Screening of Nonessential Staphylococcus aureus Genes," mBio 4(1):e00537-12 (2013), which is hereby incorporated by reference in its entirety) obtained from the Network on Antibiotic Resistance in Staphylococcus aureus (NARSA).

Procedure

Lysates were prepared from S. aureus strains JE2, NE381 (an sdgA transposon mutant of JE2) and NE105 (an sdgB transposon mutant of JE2). 25 mL cultures of the strains were grown in Tryptic Soy Broth (TSB) at 37° C., 200 rpm and cells harvested at an $OD_{600}$ of 0.4 to 0.6 by centrifugation at 6,000 rpm for 10 minutes. Cell pellets were re-suspended in 1 mL PBS containing 200 µg lysostaphin (Sigma L9043) and 250 units of universal nuclease (Pierce 88700). Cells were incubated at 37° C. for 45 minutes and then centrifuged at 13,000 rpm, 4° C. for 10 minutes. 750 µL of the upper supernatant were transferred to another tube and placed on ice. Recombinant SdrC4 protein purified from E. coli was bound to Ni-NTA agarose (Qiagen 1018244). Specifically, 100 µL of the Ni-NTA agarose was placed into a microfuge tube, centrifuged and washed once with 500 µL PBS containing protease inhibitors (Roche Complete EDTA-free). The resin was then re-suspended with approximately 300 µg protein and incubated on a rocking platform at 4° C. for 1.5 hours. The resin was then centrifuged at 12,000 rpm for 1 minute and washed once with 500 µL wash buffer (50 mM NaH2PO4, 300 mM NaCl, 10 mM imidazole, pH 8.0 plus protease inhibitors). The resin was then re-suspended in either 300 µl PBS or S. aureus lysate and incubated at 37° C. for 1 hour. After 1 hour, samples were centrifuged, washed three times with 500 µl wash buffer, and bound protein was eluted in 150 µL elution buffer (wash buffer containing 250 mM imidazole) for 5 minutes at room temperature.

For Western blot analysis, eluted proteins were heated at 70° C. for 10 minutes in 1×LDS sample buffer (Life Technologies NP0007) containing 100 mM DTT, and then electrophoresed on two 10% bis-tris NuPAGE gels in MOPS buffer at 150 volts for 1 hour and 40 minutes. Following electrophoresis, one gel was stained with colloidal blue (Life Technologies 46-7015 and 46-7016), and the other gel was blotted to PVDF membrane (Life Technologies IB401002) using the iBlot instrument. The PVDF blot was probed with mAb 5133 at a 1:500 dilution and subsequently detected using the FemtoMax kit (Rockland Immunochemicals KCA001).

Results

Figure 13:
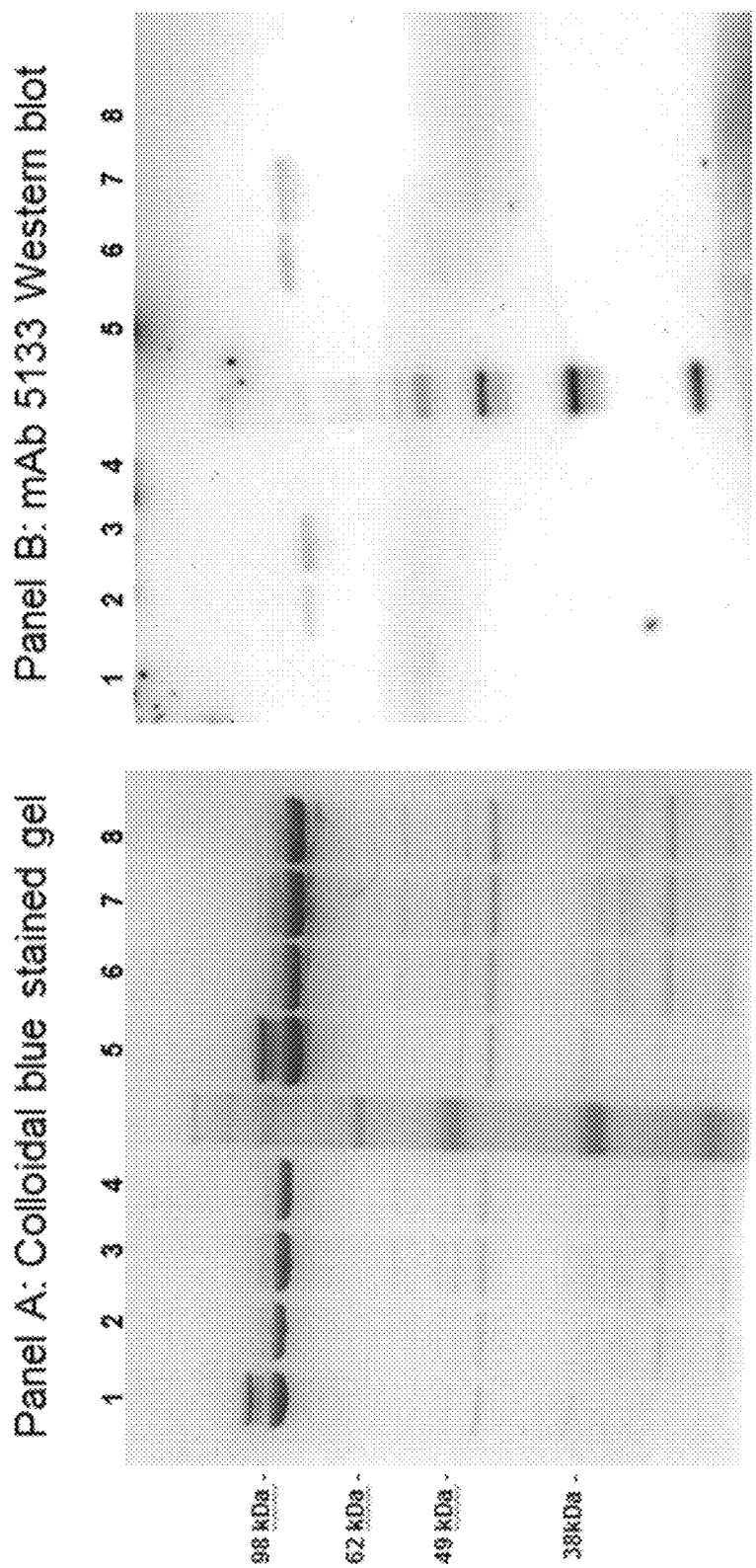
FIG. 13 shows SdgB-mediated glycosylation of a recombinant protein (SdrC4) bearing a Serine Aspartate Repeat (SDR) element results in creation of a specific epitope recognized by mAb 5133. Incubation of resin-bound SdrC4 protein with cell lysates prepared from *S. aureus* strains JE2 (FIG. 13, panel B, lanes 2 and 6) and an otherwise-isogenic sdgA mutant derivative (FIG. 13, panel B, lanes 3 and 7) results in the detection of a specific ~95 kDa species by western blot employing mAb 5133. In contrast no such protein band was detected by mAb 5133 following incubation of resin-bound SdrC4 protein with lysates prepared from an sdgB mutant derivative of *S. aureus* strain JE2 that does not express the SdgB glycosyltransferase (FIG. 13, panel B, lanes 4 and 8), or in the control PBS sample (FIG. 13, panel B, lanes 1 and 5) FIG. 13, panel A shows a colloidal blue stain of the gel corresponding to the blot of FIG. 13B, indicating that essentially equivalent amounts of the recombinant SdrC4 protein were loaded in lanes 1-4 and 5-8.

As shown in FIG. 13, incubation of resin-bound SdrC4 protein with lysates prepared from S. aureus strains JE2 (Panel B, lanes 2 and 6) and an otherwise-isogenic sdgA mutant derivative (Panel B, lanes 3 and 7) resulted in the detection of a specific ~95 kDa species in a Western blot employing mAb 5133. In contrast no such protein band was detected by mAb 5133 following incubation of resin-bound SdrC4 protein with lysates prepared from a sdgB mutant derivative of S. aureus strain JE2 (Panel B, lanes 4 and 8) or in the control sample wherein PBS replaced cell lysate (Panel B, lanes 1 and 5). The colloidal blue stained gel shown in FIG. 13, panel A indicates that essentially equivalent amounts of the recombinant SdrC4 protein were loaded in Lanes 1-4 and 5-8.

Summary

The lack of detection of the ~95 kDa protein band with mAb 5133 following incubation of column-bound SdrC4 protein with a lysate prepared from the sdgB mutant of strain JE2 further supports the contention that SdgB is a specific glycosyltransferase for the SdrC protein and is necessary for creation of the epitope of mAb 5133.

Example 15

In Vitro Glycosylation of SdrC4 or SdrC5 Protein with Purified SdgB Glycosyltransferase Protein Results in the Generation of an Epitope Recognized by mAb 5133

In order to further validate that SdgB-mediated glycosylation of SDR-containing proteins results in creation of a specific epitope recognized by mAb 5133, in vitro glycosylation of representative SDR proteins (SdrC4 or SdrC5) was undertaken using a recombinant form of the S. aureus SdgB glycosyltransferase and the reaction products separated by SDS-PAGE and analyzed by Western blot analysis.

Procedure

A recombinant form of the S. aureus SdgB glycosyltransferase bearing a C-terminal poly-histidine $(His)_6$ affinity tag (SEQ ID NO:99) was expressed in E. coli and purified via Ni-NTA affinity chromatography. For in vitro glycosylation reactions, 100 µg of recombinant SdrC4 (SEQ ID NO:100) or SdrC5 (SEQ ID NO:101) protein were incubated+/−30 µg of Uridine diphosphate N-acetylglucosamine (UDP-GlcNac)+/−4 µg of recombinant SdgB in a final volume of 100 µl 100 mM Tris pH 7.5 or 100 mM Tris pH 7.5 plus 10% glycerol at 37 C for 1 hour. For western blot analysis, reaction products were first resolved by SDS-PAGE with 1 µg of protein per lane separated on a NuPAGE 4-12% Bis-Tris Gel (NP0335BOX) at 200V constant until the dye front has reached the bottom of the gel. Proteins were then transferred to PVDF membranes (Transfer iBlot Gel Transfer Stacks PVDF IB401002) using the Invitrogen iBlot.

Figure 14A:
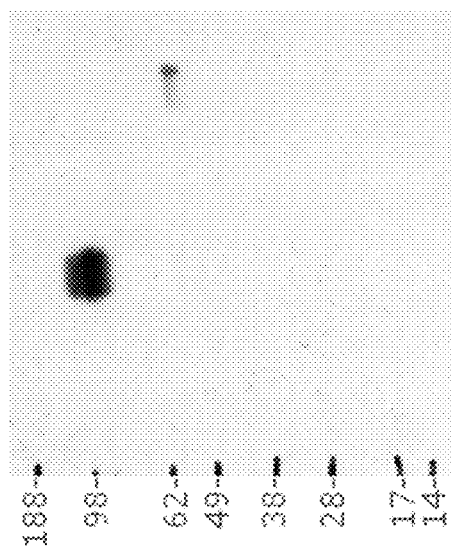
FIGS. 14A-14C are a series of western blots showing that in vitro glycosylation of recombinant proteins bearing Serine Aspartate Repeat (SDR) elements with purified, recombinant SdgB glycosyltransferase protein results in the generation of an epitope recognized by mAb 5133. Recombinant SDR proteins (SdrC4 and SdrC5) bearing poly-histidine $(His)_6$ affinity tags were incubated with buffer alone, buffer plus uridine diphosphate N-acetylglucosamine (UDP-GlcNac), or buffer plus UDP-GlcNac plus a recombinant form of the *S. aureus* SdgB glycosyltransferase. Reaction products were separated by SDS-PAGE, transferred to PVDF membranes and the resulting western blots probed with either (i) mAb 5133 as the primary antibody and detection using a secondary HRP-conjugated goat anti-human IgG (H+L) detection antibody (panel A of FIGS. 14A, 14B and 14C), or (ii) a HRP-conjugated mAb specific for the poly-histidine $(His)_6$ affinity tag (panel B of FIGS. 14A, 14B, and 14C).

In FIG. 14A, panel A, the primary antibody was Construct 3 (mAb 5133 A6; SEQ ID NOs:64 HC and 65 LC) at 2 µg/ml in PBS+3% BSA and the secondary detection antibody was HRP-conjugated goat anti-human IgG (H+L) from Jackson Immunoresearch (109-036-088 lot 101421) at a 1:10,000 dilution in PBS+3% BSA Western blots. Following incubation in an HRP chemiluminescent substrate detection solution (Pierce ECL Plus), blots were exposed to X-ray film. In FIG. 14A, panel B, the primary antibody for anti-His tag detection was a HRP-conjugated anti-6× histidine mAb (MAB050H lot EGE0608041, R&D Systems) at a 1:2000 dilution in PBS+3% BSA with subsequent detection via X-ray film.

Figure 14B:
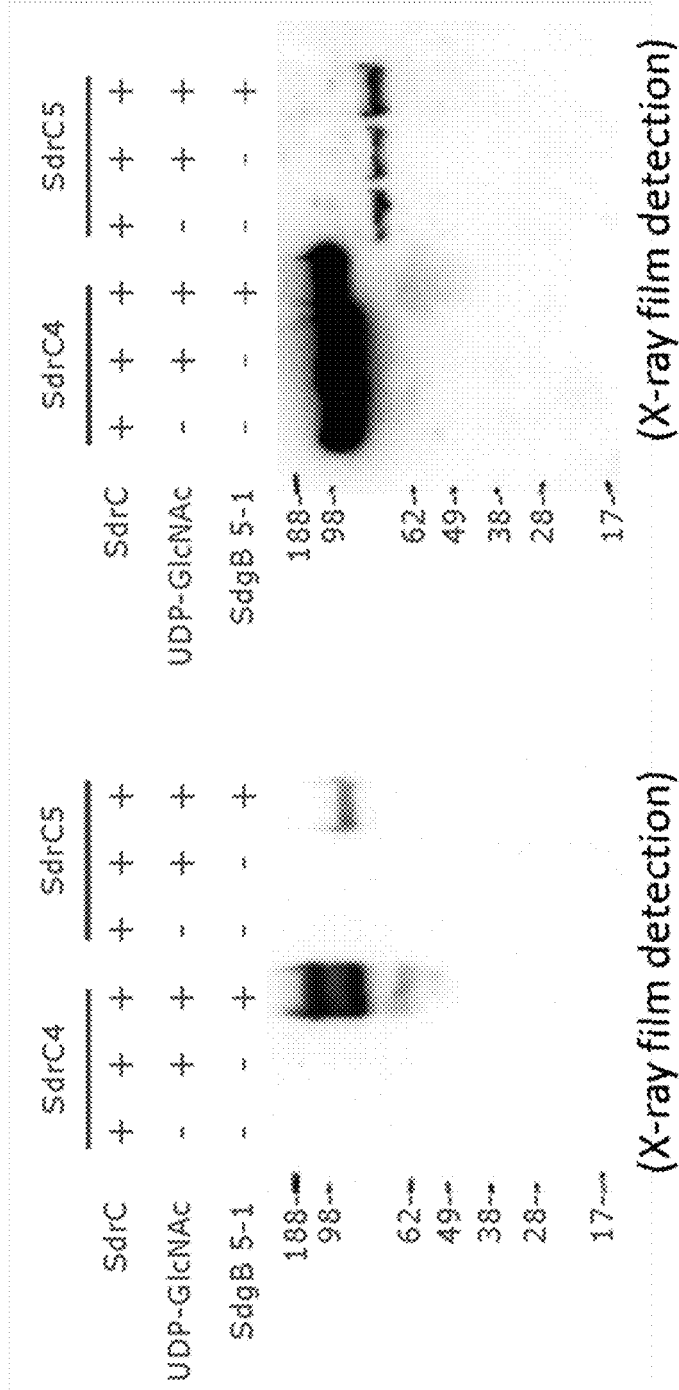

In FIG. 14B, panel A, the primary antibody was Construct 3 (mAb 5133 A6; SEQ ID NOs:64 HC and 65 LC) at 2 µg/ml in PBS+3% BSA and the secondary detection antibody was HRP-conjugated goat anti-human IgG (H+L) from Jackson Immunoresearch (109-036-088 lot 101421) at a 1:10,000 dilution in PBS+3% BSA Western blots. Following incubation in an HRP chemiluminescent substrate detection solution (Pierce ECL Plus), blots were exposed to X-ray film. The blot was then stripped using Thermo Scientific Restore Western stripping buffer and anti-his detection then undertaken using an HRP-conjugated anti-6× histidine mAb (MAB050H lot EGE0608041, R&D Systems) at a 1:2000 dilution in PBS+3% BSA with subsequent detection via X-ray film (FIG. 14B, panel B).

Figure 14C:
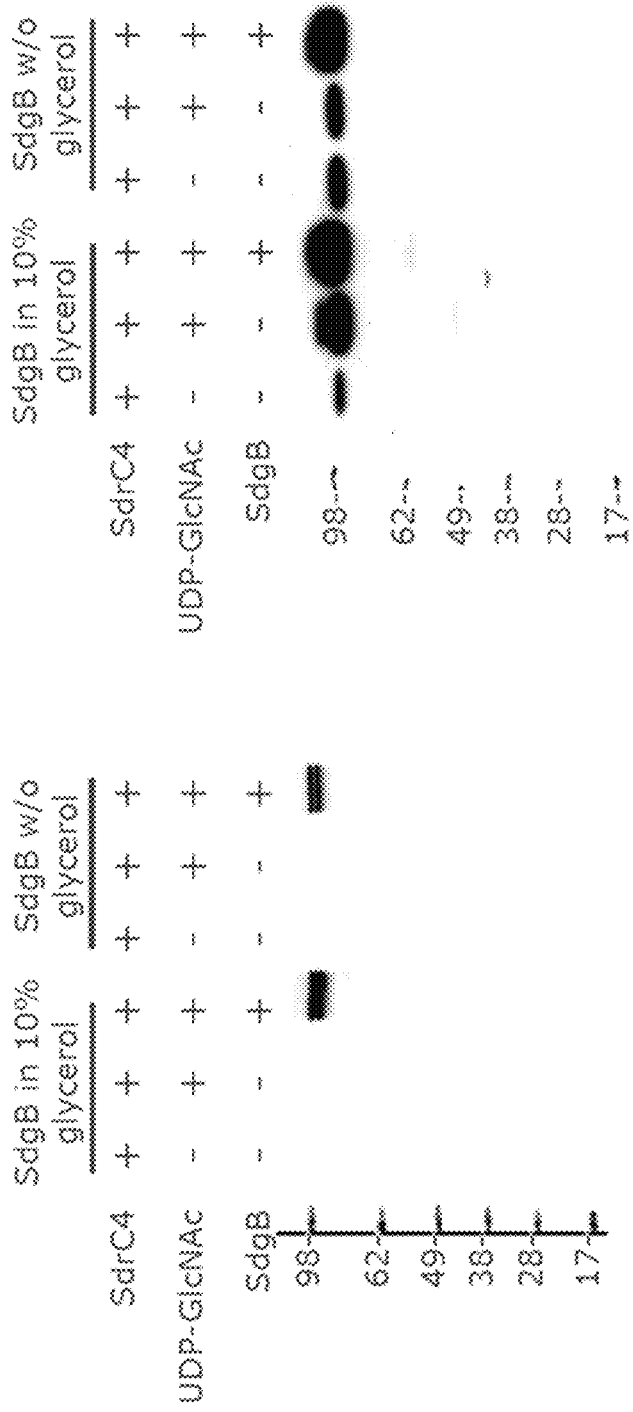

In FIG. 14C, panel A, the primary antibody was Construct 1 (mAb 5133; SEQ ID NOs:60 HC and 61 LC) at 2 µg/ml in Rockland fluorescent western blocking buffer (MB-070). The secondary detection employed IRDye 800CW goat anti-human IgG (H+L) Li-cor 926-32232 with detection using the Odyssey InfraRed imager. In FIG. 14C, panel B, anti-His detection employed the a HRP-conjugated anti-6× histidine mAb (MAB050H lot EGE0608041, R&D Systems) at a 1:2000 dilution in PBS +3% BSA with subsequent detection via X-ray film.

Results

As shown in FIGS. 14A, 14B, and 14C, the incubation of recombinant SdrC4 or SdrC5 proteins purified from E. coli in the presence of both SdgB and UDP-GlcNAc results in the generation of species detected by Construct 1 (mAb 5133; SEQ ID NOs:60 HC and 61 LC) and Construct 3 (mAb 5133 A6; SEQ ID NOs:64 HC and 65 LC). Detection of the (His)$_6$ epitopes of the SdrC4 and SdrC5 constructs in all lanes verifies that near equivalent amounts of protein were present.
Summary These results further substantiate prior observations that mAb 5133 only detects SDR family proteins following SdgB-mediated glycosylation.

Example 16 mAb 5133 does not Specifically Bind S. aureus Lipoteichoic Acid (LTA)

Figure 15:
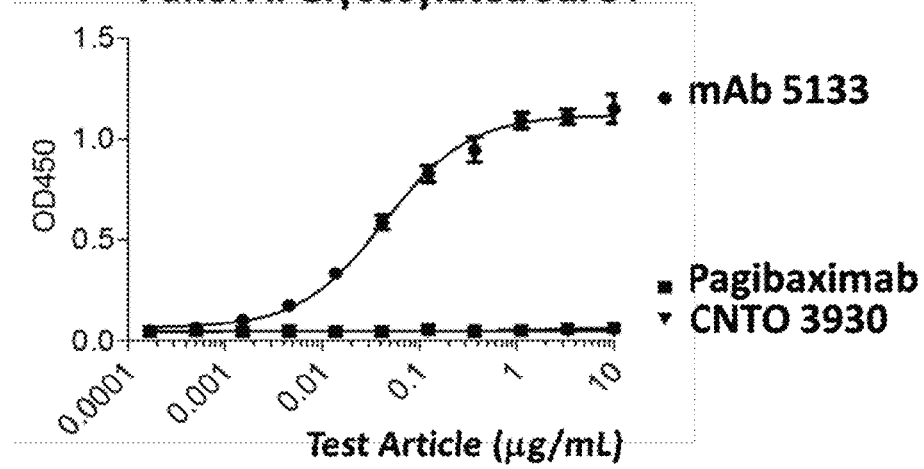
FIG. 15 shows that mAb5133 binds SdgB-glycosylated SdrC4 protein (FIG. 15, panel A), but does not bind purified *S. aureus* LTA (FIG. 15, panel B). In contrast, pagibaximab, a well characterized anti-LTA mAb, binds purified *S. aureus* LTA (panel B) but does not bind SdgB-glycosylated SdrC4 protein (panel A). ELISA format assays employed plate-immobilized, recombinant SdgB-glycosylated SdrC4 protein or purified *S. aureus* LTA and primary antibodies mAb 5133, pagibaximab or a mAb specific for the respiratory syncytial virus F (RSV-F) as a negative control for binding of either antigen.
Figure 15:
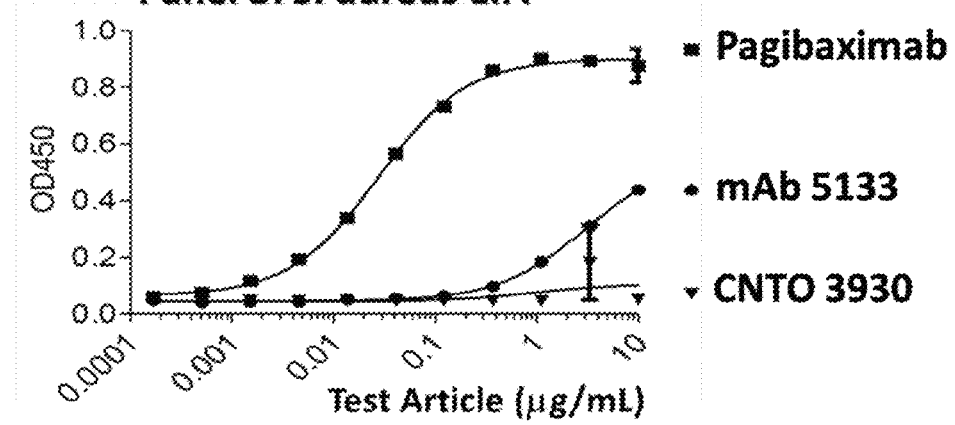

The lipoteichoic acid (LTA) of S. aureus had previously been identified as the cellular target of mAb 5133 (U.S. Pat. No. 8,460,666 to Throsby et al., which is hereby incorporated by reference in its entirety). To determine if this is indeed the case, the relative binding of mAb 5133 to surface-bound S. aureus LTA and recombinant SdgB-glycosylated SdrC4 protein was determined in parallel ELISA format assays. As a positive control for LTA binding, pagibaximab (SEQ ID NO:102 HC+SEQ ID NO:103 LC), a well characterized anti-LTA mAb (Ginsburg I., "Role of Lipoteichoic Acid in Infection and Inflammation," *Lancet Infect. Dis.* 2(3):171-9 (2002); Weisman et al., "Safety and Pharmacokinetics of a Chimerized Anti-Lipoteichoic Acid Monoclonal Antibody in Healthy Adults," *International Immunopharmacol.* 9: 639-644 (2009), which are hereby incorporated by reference in their entirety) was included. As a negative control for binding of both SdgB-glycosylated SdrC4 protein and LTA, CNTO3930 (SEQ ID NO:104 HC+SEQ ID NO:105 LC), a mAb that specifically targets the respiratory syncytial virus F (RSV-F) glycoprotein was also included.
Procedure High binding 96-well ELISA plates (Nunc) were coated with either SdgB-glycosylated recombinant SdrC4 protein or S. aureus lipoteichoic acid (LTA) (L 2515, Sigma) at 5 µg/mL in PBS and incubated overnight at 4° C. Plates were washed three times with ELISA wash buffer (0.15M NaCl, 0.02% Tween-20) and blocked with blocking buffer (Superblock Thermo 37515) for one hour at ambient temperature. In separate dilution plates, antibodies were serially diluted three-fold in 3% BSA-PBS blocking buffer starting at 10 µg/mL. ELISA plates were washed three times with ELISA wash buffer and antibody dilutions were transferred from the dilution plates to the ELISA plates and incubated for one hour at ambient temperature. ELISA plates were washed three times with ELISA wash buffer and a secondary goat anti-human Fc gamma-specific-HRP (Jackson Immunoresearch 109-035-098) was diluted 1:15,000 in blocking buffer and added to the plates. Plates were incubated with secondary antibody for one hour at ambient temperature then washed five times with ELISA wash buffer. TMB Substrate (Fitzgerald) was then added to the plates and allowed to develop for approximately four minutes, and then the reaction was stopped with addition of 0.5M HCl. Absorbance was read on the SpectraMax M5 Microplate Reader at 450 nm. The data were analyzed using GraphPad Prism. Values were transformed to a log scale and fit using a non-linear regression sigmoidal dose-response equation resulting in an eleven point binding curve for each antibody against each antigen.
Results As shown in of FIG. 15, panel A, mAb 5133 exhibits potent and concentration-dependent binding to SdgB-glycosylated SdrC4 protein. In contrast, no binding to SdgB-glycosylated SdrC4 protein is detected with either pagibaximab or CNTO 3930. FIG. 15, panel B, shows the relative binding of each test article to purified S. aureus LTA, and, as expected, pagibaximab exhibited potent and concentration-dependent binding. In contrast, no binding or very weak binding to LTA is detected with CNTO 3930 or mAb 5133, respectively. The apparent weak binding of mAb 5133 to S. aureus LTA may be accounted for by contamination of the LTA preparation with native SDR proteins as it is know that preparations of LTA are often contaminated with host proteins (Silvestri et al., "Purification of lipoteichoic acids by using phosphatidyl choline vesicles," *Infection and Immunity* 22(1):107-118 (1978), which is hereby incorporated by reference in its entirety).
Summary These results suggest that mAb 5133 recognizes SdgB-glycosylated SDR family proteins and not LTA.

Example 17 mAb 5133 and Variants Bearing the PRASA and/or A6 Mutations Retain Binding to the Human and Mouse FcRn Receptors In order to demonstrate that the PRASA and A6 mutations do not interfere significantly with the engagement of the FcRn receptor, that plays a critical role in determining the in vivo half-life of antibodies (Kuo & Aveson, "Neonatal Fc Receptor and IgG-Based Therapeutics," *mAbs* 3(5): 422-30 (2011), which is hereby incorporated by reference in its entirety), mAb 5133 and variants bearing PRASA and/or A6 mutations were tested for binding to purified human and/or mouse FcRn receptors in an ELISA format, competition binding assay (Kinder et al., "Engineered Protease-Resistant Antibodies With Selectable Cell-Killing Functions," *J. Biol. Chem.* 288:30843-30854 (2013), which is hereby incorporated by reference in its entirety).
Procedure The test articles employed were mAb 5133 (SEQ ID NOs:60 HC and 61 LC), mAb 5133 PRASA (SEQ ID NOs:62 HC and 63 LC), mAb 5133 A6 (SEQ ID NOs:64 HC and 65 LC) and mAb 5133 PRASA A6 (SEQ ID NOs:66 HC and 67 LC). CNTO 3929 (SEQ ID NOs:106 HC and 107 LC), a human IgG1 antibody targeting the respiratory syncytial virus F (RSV-F) glycoprotein, was employed as the competitor mAb. A competitive binding assay was used to assess the relative affinities of different test articles to recombinant forms of human or mouse FcRn-His$_6$ (in which the transmembrane and cytoplasmic domains of FcRn were replaced with a poly-histidine affinity tag). Prior to use in these assays, the test articles and CNTO 3929 were dialyzed into MES buffer (0.05M MES, pH 6.0) overnight at 4° C. Ninety-six-well copper-coated plates (Thermo Scientific) were used to capture FcRn-His$_6$ at 5 µg/mL in phosphate buffered saline (PBS) after which plates were washed with 0.15 M NaCl, 0.02% Tween 20, pH ~5 and then incubated with blocking reagent (0.05 M MES, 0.025% BSA, 0.001% Tween 20, pH 6.0 plus 10% ChemiBLOCKER (Millipore)). Plates were washed as previously, and then serial dilutions of competitor test antibody in blocking reagent were added to the plate in the presence of a fixed 1 µg/mL concentration of a biotinylated preparation of CNTO 3929. Plates were incubated at room temperature for 1 h, washed three times as previously, and then incubated with a 1:10,000 dilution of streptavidin-HRP (Jackson ImmunoResearch Laboratories) at room temperature for 30 min. Plates were washed five times as above, and bound streptavidin-HRP was detected by adding 3,3',5,5'-tetramethylbenzidine peroxidase substrate with Stable Stop (Fitzgerald Industries International) and incubating for 4 min. Color development was stopped by addition of 0.5 M HCl. Optical densities were determined with a SpectraMax Plus384 plate reader (Molecular Devices) at 450-nm wavelength. Data were fitted to a sigmoidal dose-response curve using GraphPad Prism v5.

Results

Figure 16:
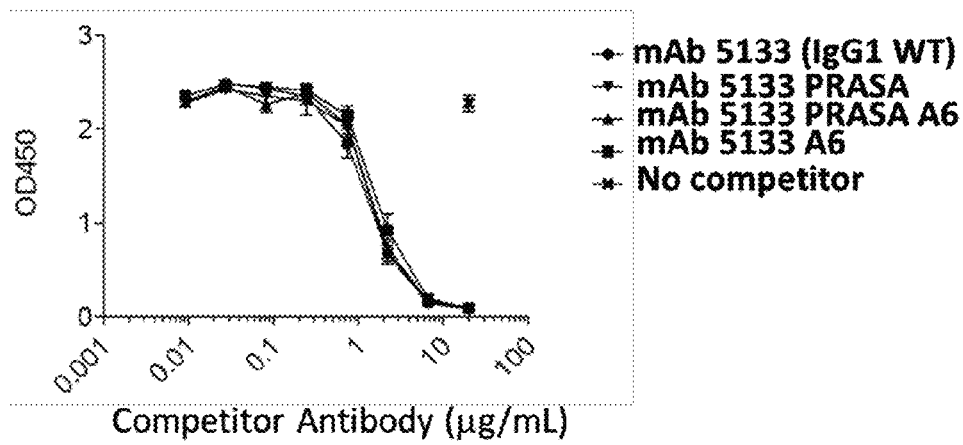
FIG. 16 shows that mAb 5133 and variants bearing mutations that eliminate GluV8-mediated protease cleavage in the hinge region (PRASA) and/or protein-A binding (A6) retain binding to both the human (FIG. 16, panel A) and mouse (FIG. 16, panel B) FcRn receptors. ELISA format competition assays employed poly-histidine tagged recombinant forms of human or mouse FcRn receptor bound on copper-coated plates, and a human IgG1 antibody targeting the respiratory syncytial virus F (RSV-F) glycoprotein (CNTO 3929) as the competitor mAb.
Figure 16:
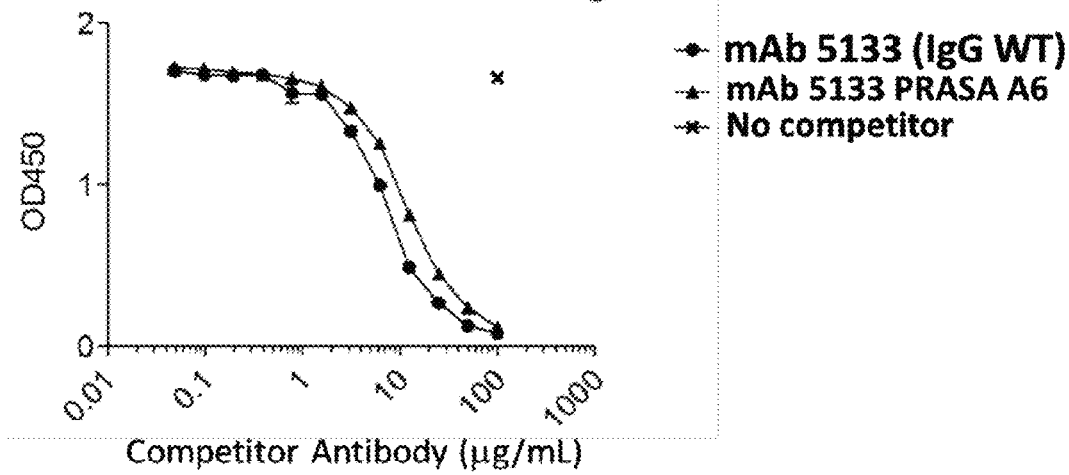

As shown in FIG. 16 (panel A), variants of mAb 5133 bearing the PRASA and/or A6 mutations exhibit indistinguishable binding to the human FcRn receptor under the conditions employed in this in vitro competitive binding assay (conducted at pH 6.0). Similarly, as shown in FIG. 16 (panel B), a variant of mAb 5133 bearing both the PRASA and A6 mutations exhibits binding to the mouse FcRn receptor which is nearly identical to that of mAb 5133 under the conditions employed in this in vitro competitive binding assay.

Summary

Introduction of the PRASA and A6 mutations, alone or in combination, have minimal if any detectable impact on the affinity of variants of mAb 5133 for the human or mouse FcRn receptor in vitro.

Example 18

Fusion Proteins Bearing the PRASA and/or A6 Mutations Retain Binding to the Human FcRn Receptor In order to demonstrate that the PRASA and A6 mutations in the context of mAb-FN3 domain fusion proteins do not interfere significantly with the engagement of the FcRn receptor, as series of fusion proteins bearing PRASA and/or A6 mutations were tested for binding to purified human FcRn receptor in an ELISA format, competition binding assay (Kinder et al., "Engineered Protease-Resistant Antibodies With Selectable Cell-Killing Functions," *J. Biol. Chem.* 288:30843-30854 (2013), which is hereby incorporated by reference in its entirety).

Procedure

The test articles employed were mAb 5133 PRASA A6 (SEQ ID NOs:66 HC and 67 LC), mAb 5133 PRASA A6 HC LukAB (SEQ ID NOs:70 HC and 71 LC), mAb 5133 PRASA A6 HC LukD (SEQ ID NOs:74 HC and 75 LC), mAb 5133 PRASA A6 HC LukD HC LukAB (SEQ ID NOs:78 HC and 79 LC) and mAb 5133 PRASA A6 HC LukAB HC LukD (SEQ ID NOs:76 HC and 77 LC). CNTO 3929 (SEQ ID NOs:106 HC and 107 LC), a human IgG1 antibody targeting the respiratory syncytial virus F (RSV-F) glycoprotein, was employed as the competitor mAb. A competitive binding assay was used to assess the relative affinities of different test articles to a recombinant form of human FcRn-His$_6$ (in which the transmembrane and cytoplasmic domains of FcRn were replaced with a poly-histidine affinity tag). Prior to use in these assays, the test articles were dialyzed into MES buffer (0.05M MES, pH 6.0) overnight at 4° C. Ninety-six-well copper-coated plates (Thermo Scientific) were used to capture FcRn-His$_6$ at 5 µg/mL in phosphate buffered saline (PBS) after which plates were washed with 0.15 M NaCl, 0.02% Tween 20, pH ~5 and then incubated with blocking reagent (0.05 M MES, 0.025% BSA, 0.001% Tween 20, pH 6.0 plus 10% Chemi-BLOCKER (Millipore)). Plates were washed as previously, and then serial dilutions of competitor test antibody in blocking reagent were added to the plate in the presence of a fixed 1 µg/mL concentration of a biotinylated preparation of CNTO 3929. Plates were incubated at room temperature for 1 h, washed three times as previously, and then incubated with a 1:10,000 dilution of streptavidin-HRP (Jackson ImmunoResearch Laboratories) at room temperature for 30 min. Plates were washed five times as above, and bound streptavidin-HRP was detected by adding 3,3',5,5'-tetramethylbenzidine peroxidase substrate with Stable Stop (Fitzgerald Industries International) and incubating for 4 min. Color development was stopped by addition of 0.5 M HCl. Optical densities were determined with a SpectraMax Plus384 plate reader (Molecular Devices) at 450-nm wavelength. Data were fitted to a sigmoidal dose-response curve using GraphPad Prism v5.

Results

Figure 17:
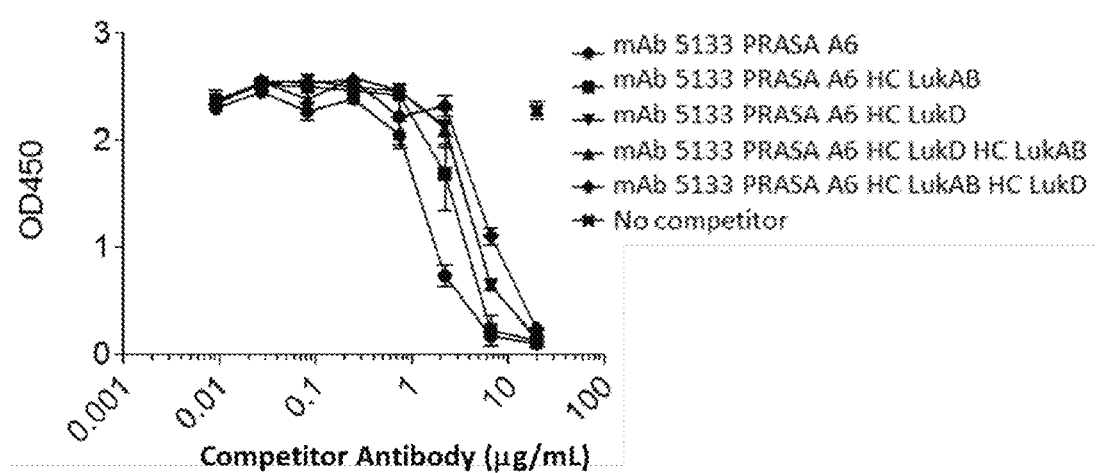
FIG. 17 shows that mAb-FN3 domain fusion proteins bearing mutations that eliminate GluV8-mediated protease cleavage in the hinge region (PRASA) and/or protein-A binding (A6) retain binding to both the human FcRn receptor. ELISA format competition assays employed poly-histidine tagged recombinant form of the human FcRn receptor bound on copper-coated plates and a human IgG1 antibody targeting the respiratory syncytial virus F (RSV-F) glycoprotein (CNTO 3929) as the competitor mAb.

As shown in FIG. 17, mAb 5133 PRASA A6-based fusion proteins bearing heavy chain appended anti-LukD and/or anti-LukAB FN3 domains exhibit binding to the human FcRn receptor under the conditions employed in this in vitro competitive binding assay (conducted at pH 6.0) with somewhat weaker binding observed for the fusion proteins compared to the parental mAb (mAb 5133 PRASA A6).

Summary

Introduction of the PRASA and A6 mutations have minimal impact on the affinity of mAb 5133-based fusion proteins for the human FcRn receptor in vitro.

Example 19

Variants of mAb 1533 Bearing the A6 Mutations are Unable to

Engage with Either of the *S. aureus* IgG Binding Proteins, Protein-A or Sbi.

*Staphylococcus aureus* expresses two known immunoglobulin binding proteins, Protein A (see Foster T. J., "Immune Evasion by Staphylococci," *Nature Reviews Microbiology* 3:948-958 (2005), which is hereby incorporated by reference in its entirety, and the second binding protein for immunoglobulins (Sbi) (Zhang et al., "A Second IgG-Binding Protein in *Staphylococcus aureus*," *Microbiology* 144:985-991 (1998), which is hereby incorporated by reference in its entirety), that are each displayed in cell-surface anchored or secreted forms (Smith et al., "The Immune Evasion Protein Sbi of *Staphylococcus aureus* Occurs Both Extracellularly and Anchored to the Cell Envelope by Binding to Lipotechoic Acid" *Mol. Microbiol.* 83:789-804 (2012); Becker et al., "Release of Protein A From the Cell Wall of *Staphylococcus aureus*," *Proc. Natl. Acad. Sci.* (USA) 112(4):1574-9 (2014), which are hereby incorporated by reference in their entirety) and share a pair of conserved helices involved in binding to the Fc region of IgG proteins (Atkins et al., "*S. aureus* IgG-binding Proteins SpA and Sbi: Host Specificity and mechanisms of Immune Complex Formation," *Mol. Immunol.* 45:1600-1611 (2008), which is hereby incorporated by reference in its entirety). In order to further demonstrate that mAb 5133 variants bearing the A6 mutations are unable to engage with either of the immunoglobulin binding proteins of *Staphylococcus aureus*, Western blot analysis of lysates prepared from a series of strains that express either both Protein A and Sbi or express only one of these two proteins.

Procedure

Test articles used for the Western analyses were mAb 5133 (SEQ ID NOs:60 HC and 61 LC), mAb 5133 A6 (SEQ ID NOs:64 HC and 65 LC) and mAb 5133 PRASA A6 (SEQ ID NOs:66 HC and 67 LC). Lysates were prepared from *S. aureus* strains JE2 (Fey et al., "A Genetic Resource for Rapid and Comprehensive Phenotype Screening of Nonessential *Staphylococcus aureus* Genes," *MBio.* 4:e00537-12 (2013), which is hereby incorporated by reference in its entirety) and Newman (Baba et al., "Genome Sequence of *Staphylococcus aureus* Strain Newman and Comparative Analysis of Staphylococcal Genomes: Polymorphism and Evolution of Two Major Pathogenicity Islands," *J. Bacteriol.* 190(1):300-10 (2008), which is hereby incorporated by reference in its entirety) both wild-type for expression of both Protein A and Sbi, derivatives of JE2 NE286 (a spa transposon insertion mutant of JE2), NE453 (a sbi transposon insertion mutant of JE2) and Wood 46 (a strain known to lack expression of Protein A (Forsgen et al., "Lymphocyte Stimulation by Protein A of *Staphylococcus aureus*," *Eur. J. Immunol.* 6:207 (1976); Ringden et al., "Activation of Human B and T Lymphocytes by Protein A of *Staphylococcus aureus*," *Eur. J. Immunol.* 8:47 (1978), which are hereby incorporated by reference in their entirety). Briefly, cultures of the strains were grown in Tryptic Soy Broth (TSB) at 37° C., 200 rpm and cells harvested from 1 mL of culture by centrifugation at 6,000 rpm for 10 minutes following overnight growth. Cell pellets were re-suspended in 1 mL of lysostaphin buffer (50 mM Tris, pH 8.0, 20 mM MgCl2 with 1 micrograms/mL lysostaphin (Sigma L-9043)). For Western analysis, ~30 microliters of each sample were mixed with ~10 microliters 4× NuPAGE LDS sample buffer (Invitrogen NP0007) and electrophoresed on a 4-12% gradient NuPAGE gels. Gels were transferred to PVDF membranes and subsequently blocked in a PBS/3% milk solution for 1 hour. Western detection test articles were incubated with the blots at 2 µg/mL in Rockland fluorescent western blocking buffer with gentle agitation at room temperature (for >=2 hours) and washed four times with 1×PBS 0.5% (10 min each wash). The blots were then incubated with a secondary antibody (goat anti-human IgG (H+L) Li-co IRDye (1:10,000) for 1 hour at room temperature and then washed 4 times in with 1×PBS 0.5% (10 min each wash). Following washing, the Western blot membranes were imaged with using an Odyssey InfraRed imager.

Results

Figure 18A:
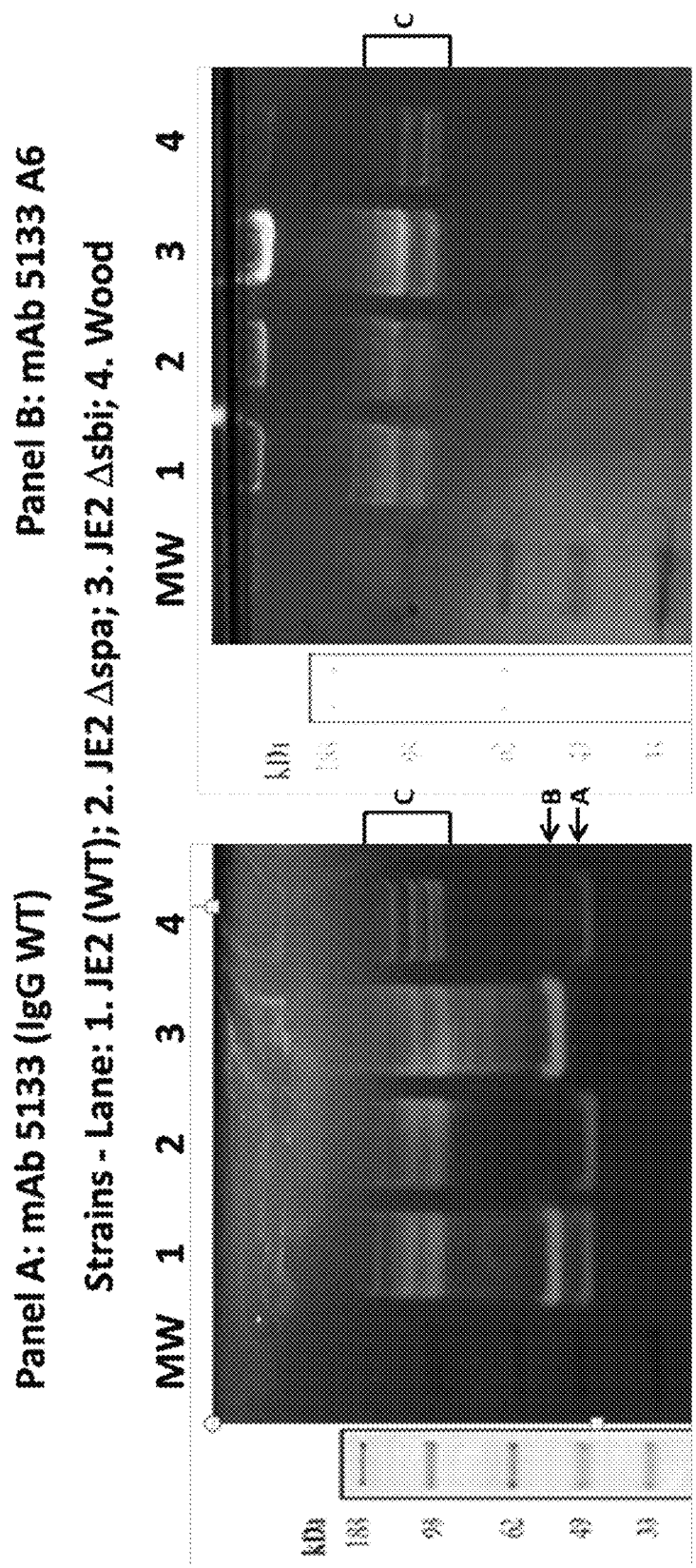
FIGS. 18A-18B show that variants of mAb 1533 bearing mutations that eliminate protein-A binding (A6) are unable to engage with either of the *S. aureus* IgG binding proteins, Protein-A or Sbi. Cell lysates were prepared from *S. aureus* strains JE2 (wild-type for expression of both Protein A and Sbi) and derivatives NE286 (a protein-A deficient spa mutant of JE2), NE453 (an sbi mutant of JE2 deficient in expression of the Sbi protein) and Wood 46 (a strain known to lack expression of Protein A), separated by SDS-PAGE, and transferred to PVDF membranes. The resulting Western blots were probed with either (i) mAb 5133 (FIG. 18, panel A), (ii) a mAb 1533 variant bearing A6 mutations that eliminate protein-A binding (FIG. 18A, panel B), or (iii) a mAb 1533 variant bearing both the A6 mutations plus mutations that eliminate GluV8-mediated protease cleavage in the hinge region (PRASA) (FIG. 18B, panel C) with secondary detection via a secondary antibody (goat anti-human IgG (H+L).
Figure 18B:
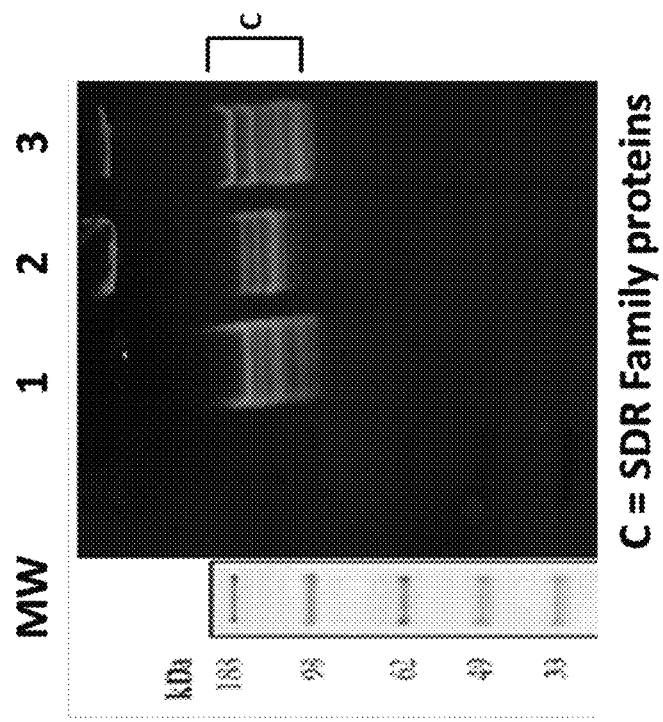

As shown in FIG. 18A, panel A, mAb 5133 detects a series of proteins (labeled C) corresponding to the glycosylated forms of Serine Aspartate Repeat (SDR) protein family members in all strains tested. For strain JE2 (Lane 1), bands migrating at approximately 55 kDa and 48 kDa are detected by mAb 5133 that correspond to Protein A and the Sbi protein, respectively. As expected, only the ~48 kDa Sbi protein is detected by mAb 5133 in lysates prepared from two strains that lack expression of Protein A: JE2 NE286 (Lane 2) and the Wood 46 strain (Lane 4). In contrast, only the ~55 kDa Protein A band is detected by mAb 5133 in lysates prepared from a strain that lacks expression of the Sbi protein: NE453 (Lane 3). As shown in FIG. 18B, panel B, no bands corresponding to either Protein A or the Sbi protein is detected in these same lysates by the mAb 5133 A6 test article and supports the notion that that the A6 mutations eliminate binding to both proteins. Similarly, as shown in FIG. 18B, panel C, the mAb 5133 PRASA A6 test article fails to detect to either Protein A or the Sbi protein in lysates prepared from *S. aureus* strains Newman or JE2 that express both of these proteins.

Summary

These results demonstrate that mAb 5133 variants bearing the A6 mutations are unable to engage with either of the immunoglobulin binding proteins of *Staphylococcus aureus*, Protein A or Sbi and substantiate prior observations from an ELISA format assay (Example 9, FIG. 8) wherein no binding to Protein A was detected for a series of test articles bearing the A6 mutations.

Example 20

Binding and Neutralization of γ-Hemolysins HlgAB and HlgCB and Panton-Valentine Leukocidin (PVL) by FN3 Domains In order to demonstrate that a sub-set of FN3 domains are able to exhibit binding to, and neutralization of, multiple leukotoxins, a series of studies were done employing the γ-hemolysins HlgAB and HlgCB and Panton-Valentine leukocidin (PVL).

Procedure

Test articles included in these studies included recombinant, purified polyhistidine-tagged versions of Luk129 (SEQ ID NO:151), Luk151 (SEQ ID NO:163), Luk188 (SEQ ID NO:185), Luk357 (SEQ ID NO:339), Luk540 (SEQ ID NO:424) and Luk647 (SEQ ID NO:526). Binding of the FN3 domains to purified, recombinant leukotoxins was determined by ELISA. Briefly, 100 µl of a 5 µg/mL solution of streptavidin (in PBS) was added per well of a 96 well White Maxisorp plate (Nunc-cat#436110) and incubated overnight at 4° C. Wells were then washed 3× with TBST (50 mM Tris HCl, pH 7.4, 150 mM NaCl, 0.1% Tween 20) and blocked with 300 µL/well with StartingBlock T20 (Pierce cat#37543) and incubated 45-60 minutes at room temperature (RT). The plate was then washed 3 times with TBST and 0.2 µg of biotinylated versions of the leukotoxin target antigen (in 100 µL) was added to each test well and the plate incubated 45-60 minutes at RT with gentle shaking. The plate was then washed 3 times with TBST. Test articles were diluted to 1 µM in StartingBlock T20 and 100 µL added to test wells and the plate incubated 45-60 minutes at RT with gentle shaking. The plate was then washed 3 times with TBST. For detection of bound test articles, 1004/well of a polyclonal anti-FN3-HRP antibody diluted 1:5000 in Starting block T20 was added and the plate incubated for 45-60 min at RT with gentle shaking. The plate was then washed 3 times with TBST. To detect bound anti-FN3-HRP antibody, 10014/well of the POD Chemiluminescence substrate (Roche-cat#11582950001) was added immediately prior to reading plates and the plates read using a Paradigm or Envision reader within 15 minutes of the substrate addition.

For leukotoxin neutralization studies, the Fn3 domain test articles (4 µg per well/10 µl of 400 µg/ml) were incubated with purified, recombinant leukotoxins for 30 mins at 4° C. Freshly isolated primary human neutrophils (hPMNs, 200,000 cells in RPMI+10 mM HEPES+0.1% HSA) were added to the mixture of toxin and FN3 domain protein to a final volume of 100 µl. Ethidium bromide was then added to the cells at 1:2000 final dilution and plates were read 30 and 60 mins post toxin addition. Following 1 hour intoxication in a 37° C. CO2 incubator, 25 µl of supernatant was carefully transferred to a new plate after spinning the plate down 1500 RPM for 10 mins. Cell Titer reagent (Promega) was added to the remaining cells and incubated for 1.5 hours. The 25 µl of supernatant were mixed with equal amounts of CytoTox-ONE™ Assay reagent (Promega) that rapidly measures the release of lactate dehydrogenase (LDH) from cells with a damaged membrane. LDH released into the culture medium was measured with a 10-minute coupled enzymatic assay that results in the conversion of resazurin into a fluorescent resorufin product. For the neutralization experiments, the following concentrations of purified, recombinant leukotoxins were used: HlgAB 1.25 µg/mL, HlgCB 0.63 µg/mL and PVL 0.31 µg/mL.

Results

Figure 19:
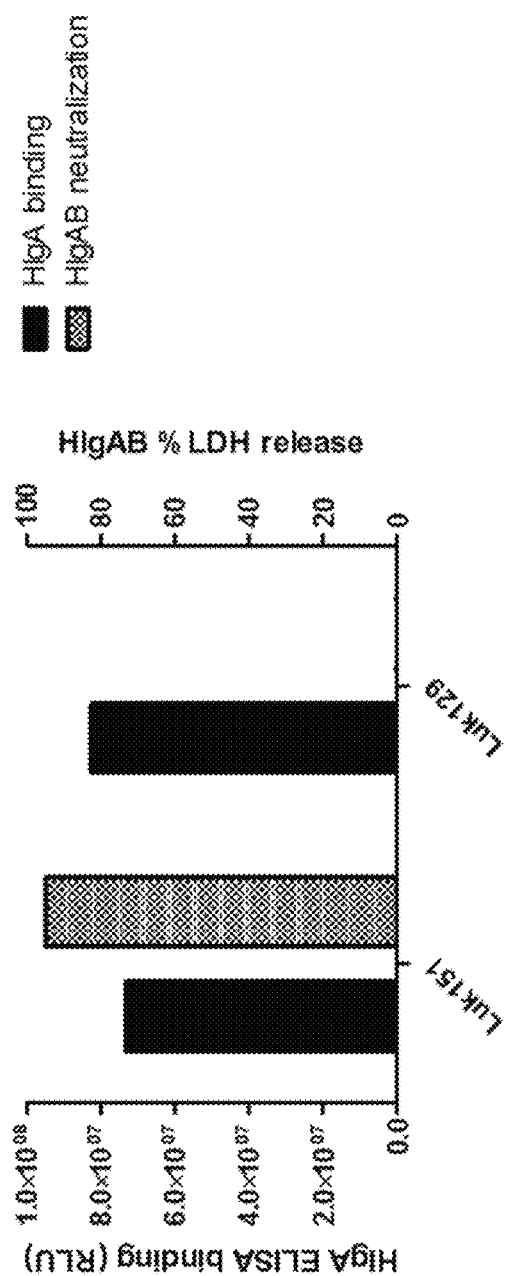
FIG. 19 shows the differential binding and neutralization of γ-hemolysin HlgAB by representative FN3 domain proteins Luk151 and Luk129. Binding of the FN3 domains to purified, recombinant HlgA was determined by ELISA. For leukotoxin neutralization studies, the FN3 domain test articles were incubated with purified, recombinant HlgAB, then freshly isolated primary human neutrophils were added and incubated for one hour at 37° C. The viability of the remaining neutrophils was determined by measuring the release of lactate dehydrogenase (LDH) from cells with a damaged membrane. As is shown in FIG. 19, the FN3 domain variant Luk151 exhibits binding to the HlgA subunit but does not neutralize the cytolytic activity of the HlgAB leukotoxin. In contrast, Luk129 exhibits binding to the HlgA subunit and neutralizes the cytolytic activity of the HlgAB leukotoxin as exemplified by complete inhibition of LDH release.

As shown in FIG. 19, the Fn3 domain variant Luk151 exhibits binding to the HlgA subunit but does not neutralize the cytolytic activity of the HlgAB leukotoxin. In contrast, Luk129 exhibits binding to the HlgA subunit and neutralizes the cytolytic activity of the HlgAB leukotoxin as exemplified by complete inhibition of LDH release.

Figure 20:
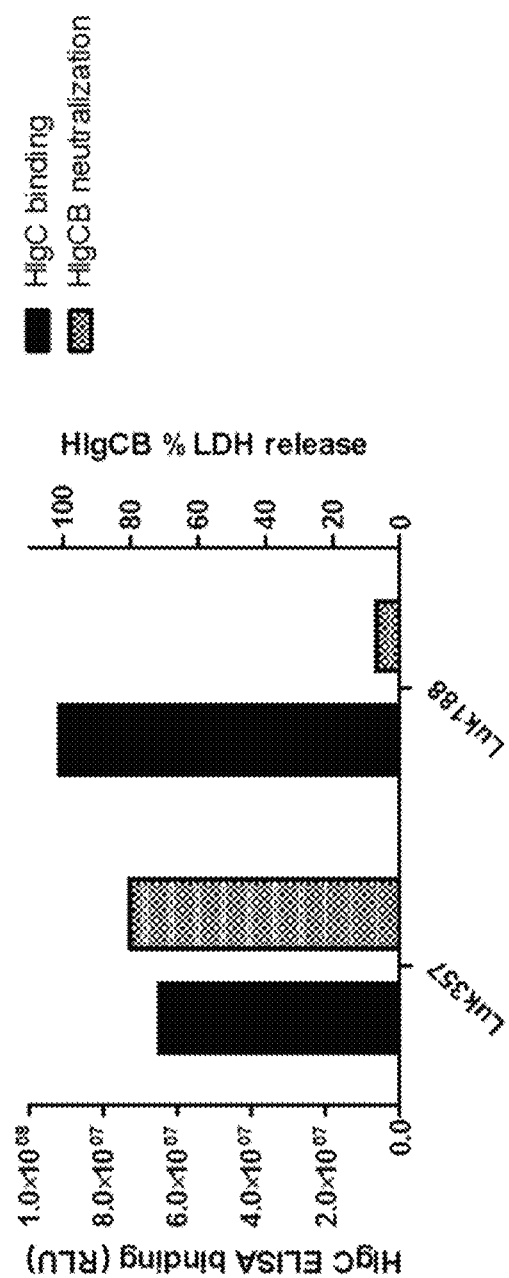
FIG. 20 shows the differential binding and neutralization of γ-hemolysin HlgCB by representative FN3 domain proteins Luk357 and Luk188. Binding of the FN3 domains to purified, recombinant HlgC was determined by ELISA. For leukotoxin neutralization studies, the FN3 domain test articles were incubated with purified, recombinant HlgCB, then freshly isolated primary human neutrophils were added and incubated for one hour at 37° C. The viability of the remaining neutrophils was determined by measuring the release of LDH from cells with a damaged membrane. As is shown in FIG. 20, the FN3 domain variant Luk357 exhibits binding to the HlgC subunit but does not neutralize the cytolytic activity of the HlgCB leukotoxin. In contrast, Luk188 exhibits binding to the HlgC subunit and neutralizes the cytolytic activity of the HlgCB leukotoxin as exemplified by complete inhibition of LDH release.

As shown in FIG. 20, the Fn3 domain variant Luk357 exhibits binding to the HlgC subunit but does not neutralize the cytolytic activity of the HlgCB leukotoxin. In contrast, Luk188 exhibits binding to the HlgC subunit and neutralizes the cytolytic activity of the HlgCB leukotoxin as exemplified by complete inhibition of LDH release.

Figure 21:
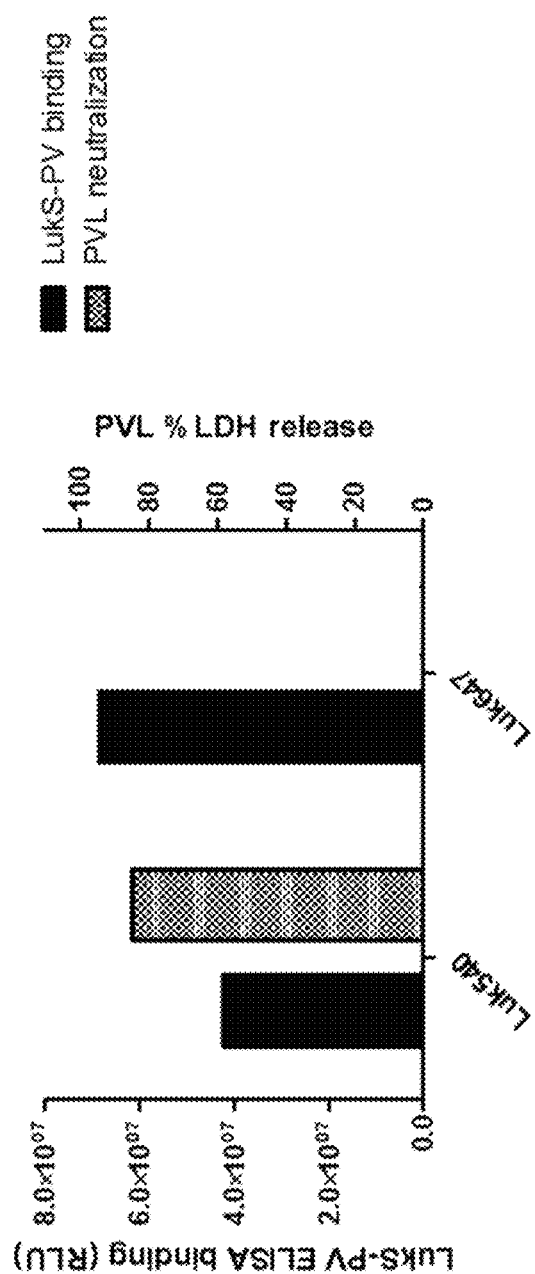
FIG. 21 shows the differential binding and neutralization of the Panton-Valentine leukocidin (PVL) by representative FN3 domain proteins Luk540 and Luk647. Binding of the FN3 domains to purified, recombinant LukS-PV was determined by ELISA. For leukocidin neutralization studies, the FN3 domain test articles were incubated with purified, recombinant PVL leukocidin, then freshly isolated primary human neutrophils were added and incubated for one hour at 37° C. The viability of the remaining neutrophils was determined by measuring the release of LDH from cells with a damaged membrane.

As shown in FIG. 21, the Fn3 domain variant Luk540 exhibits binding to the LukS-PV subunit of the PVL leukotoxin but does not neutralize the cytolytic activity of PVL. In contrast, Luk647 exhibits binding to the LukS-PV subunit of the PVL leukotoxin and neutralizes the cytolytic activity of the PVL leukotoxin as exemplified by complete inhibition of LDH release.

Summary

FN3 domains have been identified that exhibit binding to and/or neutralization of the γ-hemolysins HlgAB and HlgCB and Panton-Valentine leukocidin (PVL).

TABLE 6

Nucleic Acid and Amino Acid Sequences of the Disclosure

| SEQ ID NO: | Type | Species | Description | Sequence |
|---|---|---|---|---|
| 1 | PRT | Artificial | Tencon | LPAPKNLVVSRVTEDSARLSWTAPDAAFDSFLI QYQESEKVGEAINLTVPGSERSYDLTGLKPGTE YTVSIYGVKGGHRSNPLSAEFTT |
| 2 | PRT | Artificial | Linker | GGGGSGGGGSGGGGSGGGGS |
| 3 | PRT | Artificial | Tencon BC loop | TAPDAA |
| 4 | PRT | Artificial | Tencon FG loop | KGGHRSN |
| 5 | DNA | Artificial | POP2222 | CGGCGGTTAGAACGCGGCTAC |
| 6 | DNA | Artificial | POP2250 | CGGCGGTTAGAACGCGGCTACAATTAATAC |
| 7 | DNA | Artificial | DidLigRev | CATGATTACGCCAAGCTCAGAA |
| 8 | DNA | Artificial | MDD40 | AGCCGCCGCCACCGGTTAATGGTGATGGTG ATGGTGACCACCGGTGGTGAAGATCGCAGA CAG |
| 9 | DNA | Artificial | MDD62 | AAGAAGGAGAACCGGTATGCTGCCGGCGCC GAAAAACCTGGTTGTTTCTCGTGTTACC |
| 10 | PRT | S. aureus | LukA | HHHHHHNSAHKDSQDQNKKEHVDKSQQKD KRNVTNKDKNSTAPDDIGKNGKITKRTETVY DEKTNILQNLQFDFIDDPTYDKNVLLVKKQGS IHSNLKFESHKEEKNSNWLKYPSEYHVDFQV KRNRKTEILDQLPKNKISTAKVDSTFSYSSGG KFDSTKGIGRTSSNSYSKTISYNQQNYDTIASG KNNNWHVHWSVIANDLKYGGEVKNRNDELL FYRNTRIATVENPELSFASKYRYPALVRSGFN PEFLTYLSNEKSNEKTQFEVTYTRNQDILKNR PGIHYAPPILEKNKDGQRLIVTYEVDWKNKTV KVVDKYSDDNKPYKAG |
| 11 | PRT | S. aureus | LukB | KINSEIKQVSEKNLDGDTKMYTRTATTSDSQK NITQSLQFNFLTEPNYDKETVFIKAKGTIGSGL RILDPNGYWNSTLRWPGSYSVSIQNVDDNNN TNVTDFAPKNQDESREVKYTYGYKTGGDFSI NRGGLTGNITKESNYSETISYQQPSYRTLLDQS TSHKGVGWKVEAHLINNMGHDHTRQLTNDS DNRTKSEIFSLTRNGNLWAKDNFTPKDKMPV TVSEGFNPEFLAVMSHDKKDKGKSQFVVHYK RSMDEFKIDWNRHGFWGYWSGENHVDKKEE KLSALYEVDWKTHNVKFVKVLNDNEKK |
| 12 | PRT | S. aureus | LukD | MGSSHHHHHHSSGLVPAGSHMLAQHITPVSE KKVDDKITLYKTTATSDNDKLNISQILTFNFIK DKSYDKDTLVLKAAGNINSGYKKPNPKDYN YSQFYWGGKYNVSVSSESNDAVNVVDYAPK NQNEEFQVQQTLGYSYGGDINISNGLSGGLN GSKSFSETINYKQESYRTTIDRKTNHKSIGWG VEAHKIMNNGWGPYGRDSYDPTYGNELFLG |

TABLE 6-continued

Nucleic Acid and Amino Acid Sequences of the Disclosure

| SEQ ID NO: | Type | Species | Description | Sequence |
|---|---|---|---|---|
| | | | | GRQSSSNAGQNFLPTHQMPLLARGNFNPEFIS VLSHKQNDTKKSKIKVTYQREMDRYTNQWN RLHWVGNNYKNQNTVTFTSTYEVDWQNHTV KLIGTDSKETNPGV |
| 13 | PRT | S. aureus | LukE | MGSSHHHHHHSSGLVPAGSHMLNTNIENIGD GAEVIKRTEDVSSKKWGVTQNVQFDFVKDK KYNKDALIVKMQGFINSRTSFSDVKGSGYELT KRMIWPFQYNIGLTTKDPNVSLINYLPKNKIE TTDVGQTLGYNIGGNFQSAPSIGGNGSFNYSK TISYTQKSYVSEVDKQNSKSVKWGVKANEFV TPDGKKSAHDRYLFVQSPNGPTGSAREYFAP DNQLPPLVQSGFNPSFITTLSHEKGSSDTSEFEI SYGRNLDITYATLFPRTGIYAERKHNAFVNRN FVVRYEVNWKTHEIKVKGHN |
| 14 | PRT | Artificial | Luk17 | LPAPKNLVVSRVTEDSARLSWTAPDAAFDSF WITYEEKFYRGEAIVLTVPGSERSYDLTGLKP GTEYKVWIVGVKGGQGSWPLSAIFTT |
| 15 | PRT | Artificial | Luk19 | LPAPKNLVVSRVTEDSARLSWYHAIHRLNHF DSFLIQYQESEKVGEAIVLTVPGSERSYDLAG LKPGTEYTVSIYGVLPDAFVSSNPLSAIFTT |
| 16 | PRT | Artificial | Luk20 | LPAPKNLVVSRVTEDSARLSWYHAIHRLNHF DSFLIQYQESEKVGEAIVLTVPGSERSYDLTGL KPGTEYTVSIYGVLPDAFVSSNPLSAIFTT |
| 17 | PRT | Artificial | Luk24 | LPAPKNLVVSRVTEDSARLSWTAPDAAFDSF QIGYFELWPNGEAIVLTVPGSERSYDLTGLKP GTEYEVFIRGVKGGLYSYPLSAIFTT |
| 18 | PRT | Artificial | Luk8 | LPAPKNLVVSRVTEDSARLSWKRKPWAPIFDS FLIQYQESEKVGEAIVLTVPGSERSYDLTGLKP GTEYTVSIYGVWDHAGPKYEIESNPLSAIFTT |
| 19 | PRT | Artificial | Luk9 | LPAPKNLVVSRVTEDSARLSWDRTYSLLNYF DSFLIQYQESEKVGEAIVLTVPGSERSYDLTGL KPGTEYTVSIYGVGGQHPTYESNPLSAIFTT |
| 20 | PRT | Artificial | Luk10 | LPAPKNLVVSRVTEDSARLSWAASENAFVFD SFLIQYQESEKVGEAIVLTVPGSERSYDLTGLK PGTEYTVSIYGVGGKLHNQFEWLSNPLSAIFT T |
| 21 | PRT | Artificial | Luk11 | LPAPKNLVVSRVTEDSARLSWRAKPWAPKFD SFLIQYQESEKVGEAIVLTVPGSERSYDLTGLK PGTEYTVSIYGVSAIKPGHTSNPLSAIFTT |
| 22 | PRT | Artificial | Luk12 | LPAPKNLVVSRVTEDSARLSWRAKPWAPKFD SFLIQYQESEKVGEAIVLTVPGSERSYDLTGLK PGTEYTVSIYGVKASEKFIESNPLSAIFTT |
| 23 | PRT | Artificial | Luk21 | LPAPKNLVVSRVTEDSARLSWVTKPWAEYFD SFLIQYQESEKVGEAIVLTVPGSERSYDLTGLK PGTEYTVSIYGVWDHAGPKYEIESNPLSAIFTT |
| 24 | PRT | Artificial | Luk22 | LPAPKNLVVSRVTEDSARLSWRAKPWAPKFD SFLIQYQESEKVGEAIVLTVPGSERSYDLTGLK PGTEYAVSIYGVKASEKFIESNPLSAIFTT |
| 25 | PRT | Artificial | Luk26 | LPAPKNLVVSRVTEDSARLSWTAPDAAFDSF HIEYAEPWVWGEAIVLTVPGSERSYDLTGLKP GTEYVVFIGGVKGGHNSTPLSAIFTT |
| 26 | PRT | Artificial | Luk27 | LPAPKNLVVSRVTEDSARLSWTAPDAAFDSFP IVYQEWQFYGEAIVLTVPGSERSYDLTGLKPG TEYLVDIYGVKGGSWSYPLSAIFTT |
| 27 | PRT | Artificial | Luk28 | LPAPKNLVVSRVTEDSARLSWTAPDAAFDSF AIQYWEWWPPGEAIVLTVPGSERSYDLTGLK PGTEYGVIILGVKGGWYSNPLSAIFTT |

TABLE 6-continued

Nucleic Acid and Amino Acid Sequences of the Disclosure

| SEQ ID NO: | Type | Species | Description | Sequence |
|---|---|---|---|---|
| 28 | PRT | Artificial | Luk29 | LPAPKNLVVSRVTEDSARLSWDEQFVSNFDSF LIQYQESEKVGEAIVLTVPGSERSYDLTGLKP GTEYTVSIYGVFVPWDGFSEINYSNPLSAIFTT |
| 29 | PRT | Artificial | Luk30 | LPAPKNLVVSRVTEDSARLSWAFNWNYFAFD SFLIQYQESEKVGEAIVLTVPGSERSYDLTGLK PGTEYTVSIYGVVALNTGNKKSNPLSAIFTT |
| 30 | PRT | Artificial | Luk31 | LPAPNNLVVSRVTEDSARLSWDWDKYYTNR FDSFLIQYQESEKVGEAIVLTVPGSERSYDLTG LKPGTEYTVSIYGVLVRDYIRAAEWYSNPLSA IFTT |
| 31 | PRT | Artificial | Luk32 | LPAPKNLVVSRVTEDSARLSWYHENAYLLFD SFLIQYQESEKVGEAIVLTVPGSERSYDLTGLK PGTEYTVSIYGVVYDLTPEKRSSNPLSAIFTT |
| 32 | PRT | Artificial | Luk33 | LPAPKNLVVSRVTEDSARLSWTAPDAAFDSFL IQYQESEKVGEAIVLTVPGSERSYDLTGLKPG TEYTVSIYGVAFIPDEIEFSNPLSAIFTT |
| 33 | PRT | Artificial | Luk34 | LPAPKNLVVSRVTEDSARLSWTAPDAAFDSFL IQYQESEKVGEAIVLTVPGSERSYDLTGPKPG TEYTVSIYGVVVPHEFEFSNPLSAIFTT |
| 34 | PRT | Artificial | Luk35 | LPAPKNLVVSRVTEDSARLSWTAPDAAFDSFL IQYQESEKVGEAIVLTVPGSERSYDLTGLKPG TEYTVSIYGVAHIPWEFEWSKPLSAIFTT |
| 35 | PRT | Artificial | Luk36 | LPAPKNLVVSRVTEDSARLSWTAPDAAFDSFL IQYQESEKVGEAIVLTVPGSERSYDLTGLKPG TEYTVSIYGVADVPDEYEFSNPLSAIFTT |
| 36 | PRT | Artificial | Luk37 | LPAPKNLVVSRVTEDSARLSWTAPDAAFDSFL IQYQESEKVGEAIVLTVPGSERSYDLTGLKPG TEYTVSIYGVVGWPLFIQSNPLSAIFTT |
| 37 | PRT | Artificial | Luk38 | LPAPKNLVVSRVTEDSARLSWTAPDAAFDSFL IQYQESEKVGEAIVLTVPGSERSYDLTGLKPG TEYTVSIYGVELIYHGWLDFVFSNPLSAIFTT |
| 38 | PRT | Artificial | Luk39 | LPAPKNLVVSRVTEDSARLSWTAPDAAFDSFL IQYQESEKVGEAIVLTVPGSERSYDLTGLKPG TEYTVSIYGVRVFYFSVEPTWFSNPLSAIFTT |
| 39 | PRT | Artificial | Luk40 | LPAPKNLVVSRVTEDSARLSWTAPDAAFDSFL IQYQESEKVGEAIVLTVPGSERSYDLTGLKPG TEYTVSIYGVSYAGEPLLWIYSNPLSAIFTT |
| 40 | PRT | Artificial | Luk41 | LPAPKNLVVSRVTEDSARLSWTAPDAAFDSFL IQYQESEKVGEAIVLTVPGSERSYDLTGLKPG TEYTVSIYGVSEVPYSEYWFSNPLSAIFTT |
| 41 | PRT | Artificial | Luk42 | LPAPKNLVVSRVTEDSARLSWTAPDAAFDSFL IQYQESEKVGEAIVLTVPGSERSYDLTGLKPG TEYTVSIYGVVWGYRLTTEHSNPLSAIFTT |
| 42 | PRT | Artificial | Luk43 | LPAPKNLVVSRVTEDSARLSWTAPDAAFDSFL IQYQESEKVGEAIVLTVPGSERSYDLTGLKPG TEYTVSIYGVNSFGRPTLNLFSNPLSAIFTT |
| 43 | PRT | Artificial | Luk44 | LPAPKNLVVSRVTEDSARLSWTAPDAAFDSFL IQYQESEKVGEAIVLTVPGSERSYDLTGLKPG TEYTVSIYGVEWLQYYGETLFSNPLSAIFTT |
| 44 | PRT | Artificial | Luk45 | LPAPKNLVVSRVTEDSARLSWTAPDAAFDSFL IQYQESEKVGEAIVLTVPGSERSYDLTGLKPG TEYTVSIYGVAWLTNAYEWEFSNPLSAIFTT |
| 45 | PRT | Artificial | Luk46 | LPAPKNLVVSRVTEDSARLSWTAPDAAFDSF WIHYEESTWAGEAIVLTVPGSERSYDLTGLKP GTEYGVVIVGVKGGLKSHPLSAIFTT |

TABLE 6-continued

Nucleic Acid and Amino Acid Sequences of the Disclosure

| SEQ ID NO: | Type | Species | Description | Sequence |
|---|---|---|---|---|
| 46 | PRT | Artificial | Luk47 | LPAPKNLVVSRVTEDSARLSWTAPDAAFDSF GIQYFETTESGEAIVLTVPGSERSYDLTGLKPG TEYVVFISGVKGGPLSWPLSAIFTT |
| 47 | PRT | Artificial | Luk48 | LPAPKNLVVSRVTEDSARLSWTAPDAAFDSF HIEYGEWWPTGEAIVLTVPGSERSYDLTGLKP GTEYGVLIVGVKGGFRSSPLSAIFTT |
| 48 | PRT | Artificial | Luk49 | LPAPKNLVVSRVTEDSARLSWTAPDAAFDSF AIVYAEHWPAGEAIVLTVPGSERSYDLTGLKP GTEYNVTIPGVKGGKYSDPLSAIFTT |
| 49 | PRT | Artificial | Luk50 | LPAPKNLVVSRVTEDSARLSWTAPDAAFDSF VIPYSEWWPVGEAIVLTVPGSERSYDLTGLKP GTEYGVYIVGVKGGTWSAPLSAIFTT |
| 50 | PRT | Artificial | Luk51 | LPAPKNLVVSRVTEDSARLSWTAPDAAFDSF QIHYFESEPGGEAIVLTVPGSERSYDLTGLKPG TEYVVFIIGVKGGWSSLPLSAIFTT |
| 51 | PRT | Artificial | Luk52 | LPAPKNLVVSRVTEDSARLSWTAPDAAFDSF WIQYGEAQEFGEAIVLTVPGSERSYDLTGLKP GTEYIVFITGVKGGNKSYPLSAIFTT |
| 52 | PRT | Artificial | Luk53 | LPAPKNLVVSRVTEDSARLSWTAPDAAFDSFT IQYFEAEANGEAIVLTVPGSERSYDLTGLKPG TEYLVFIVGVKGGHSSLPLSAIFTT |
| 53 | PRT | Artificial | Luk54 | LPAPKNLVVSRVTEDSARLSWTAPDAVFDSF RIEYSEWWPIGEAIVLTVPGSERSYDLTGLKP GTEYGVVIAGVKGGGYSVPLSAIFTT |
| 54 | PRT | Artificial | Luk55 | LPAPKNLVVSRVTEDSARLSWTAPDAAFDSF WIQYFESAGEGEAIVLTVPGSERSYDLTGLKP GTEYLVFIVGVKGGVPSYPLSAIFTT |
| 55 | PRT | Artificial | Luk56 | LPAPKNLVVSRVTEDSARLSWTAPDAAFDSF YIQYIELEIGEAIVLTVPGSERSYDLTGLKPGTE YGVFISGVKGGWNSYPLSAIFTT |
| 56 | PRT | Artificial | Luk57 | LPAPKNLVVSRVTEDSARLSWTAPDAAFNSF YIEYFEWFPAGEAIVLTVPGSERSYDLTGLKP GTEYAVIIHGVKGGQRSTPLSAIFTT |
| 57 | PRT | Artificial | Luk58 | LPAPKNLVVSRVTEDSARLSWTAPDAAFDSF DIEYDESAHFGEAIVLTVPGSERSYDLTGLKP GTEYIVFIYGVKGGYASIPLSAIFTT |
| 58 | PRT | Artificial | Luk59 | LPAPKNLVVSRVTEDSARLSWTAPDAAFDSF DISYNEFAWSGEAIVLTVPGSERSYDLTGLKP GTEYVVYIHGVKGGPTSYPLSAIFTT |
| 59 | PRT | Artificial | Luk60 | LPAPKNLVVSRVTEDSARLSWTAPDAAFDSF DIQYWEWWPFGEAIVLTVPGSERSYDLTGLK PGTEYGVIILGVKGGFRSTPLSAIFTT |
| 60 | PRT | Human | CR5133 Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPELLGGPSVFLFPPKPKDT LMISRTPEVTCVVVDVSHEDPEVKFNWYVDG VEVHNAKTKPREEQYNSTYRVVSVLTVLHQD WLNGKEYKCKVSNKALPAPIEKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNHYT QKSLSLSPGK |

TABLE 6-continued

Nucleic Acid and Amino Acid Sequences of the Disclosure

| SEQ ID NO: | Type | Species | Description | Sequence |
|---|---|---|---|---|
| 61 | PRT | Human | CR5133 Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 62 | PRT | Human | CR5133 PRASA Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNHYT QKSLSLSPGK |
| 63 | PRT | Human | CR5133 PRASA Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 64 | PRT | Human | CR5133 A6 Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPELLGGPSVFLFPPKPKDT LMISRTPEVTCVVVDVSHEDPEVKFNWYVDG VEVHNAKTKPREEQYNSTYRVVSVLTVLHQD WLNGKEYKCKVSNKALPAPIEKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGK |
| 65 | PRT | Human | CR5133 A6 Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 66 | PRT | Human | CR5133 PRASA A6 Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGK |

TABLE 6-continued

Nucleic Acid and Amino Acid Sequences of the Disclosure

| SEQ ID NO: | Type | Species | Description | Sequence |
|---|---|---|---|---|
| 67 | PRT | Human | CR5133 PRASA A6 Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 68 | PRT | Artificial | CR5133 PRASA A6 LC-D Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGK |
| 69 | PRT | Artificial | CR5133 PRASA A6 LC-D Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGECGGGGSGGGGS GGGGSGGGGSLPAPKNLVVSRVTEDSARLSW RAKPWAPKFDSFLIQYQESEKVGEAIVLTVPG SERSYDLTGLKPGTEYTVSIYGVKASEKFIESN PLSAIFTT |
| 70 | PRT | Artificial | CR5133 PRASA A6 HC-AB Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGKGGGGSGGGGSGGGGSGGGGS MLPAPKNLVVSRVTEDSARLSWTAPDAAFDS FWITYEEKFYRGEAIVLTVPGSERSYDLTGLK PGTEYKVWIVGVKGGQGSWPLSAIFTT |
| 71 | PRT | Artificial | CR5133 PRASA A6 HC-AB Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 72 | PRT | Artificial | CR5133 PRASA A6 LC-D HC-AB Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP |

TABLE 6-continued

Nucleic Acid and Amino Acid Sequences of the Disclosure

| SEQ ID NO: | Type | Species | Description | Sequence |
|---|---|---|---|---|
| | | | | REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGKGGGGSGGGGSGGGGSGGGGS MLPAPKNLVVSRVTEDSARLSWTAPDAAFDS FWITYEEKFYRGEAIVLTVPGSERSYDLTGLK PGTEYKVWIVGVKGGQGSWPLSAIFTT |
| 73 | PRT | Artificial | CR5133 PRASA A6 LC-D HC-AB Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGECGGGGSGGGGS GGGGSGGGGSLPAPKNLVVSRVTEDSARLSW RAKPWAPKFDSFLIQYQESEKVGEAIVLTVPG SERSYDLTGLKPGTEYTVSIYGVKASEKFIESN PLSAIFTT |
| 74 | PRT | Artificial | CR5133 PRASA A6 HC-D Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGKGGGGSGGGGSGGGGSGGGGSL PAPKNLVVSRVTEDSARLSWRAKPWAPKFDS FLIQYQESEKVGEAIVLTVPGSERSYDLTGLKP GTEYTVSIYGVKASEKFIESNPLSAIFTT |
| 75 | PRT | Artificial | CR5133 PRASA A6 HC-D Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 76 | PRT | Artificial | CR5133 PRASA A6 HC AB-D Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGKGGGGSGGGGSGGGGSGGGGS MLPAPKNLVVSRVTEDSARLSWTAPDAAFDS FWITYEEKFYRGEAIVLTVPGSERSYDLTGLK PGTEYKVWIVGVKGGQGSWPLSAIFTTGGGG SGGGGSGGGGSGGGGSLPAPKNLVVSRVTED SARLSWRAKPWAPKFDSFLIQYQESEKVGEAI VLTVPGSERSYDLTGLKPGTEYTVSIYGVKAS EKFIESNPLSAIFTT |
| 77 | PRT | Artificial | CR5133 PRASA A6 HC AB-D Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS |

TABLE 6-continued

Nucleic Acid and Amino Acid Sequences of the Disclosure

| SEQ ID NO: | Type | Species | Description | Sequence |
|---|---|---|---|---|
| | | | | VVCLLNNFYPREAKVQWKVDNALQSGNSQE SVTEQDSKDSTYSLSSTLTLSKADYEKHKVYA CEVTHQGLSSPVTKSFNRGEC |
| 78 | PRT | Artificial | CR5133 PRASA A6 HC D-AB Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGKGGGGSGGGGSGGGGSGGGGSL PAPKNLVVSRVTEDSARLSWRAKPWAPKFDS FLIQYQESEKVGEAIVLTVPGSERSYDLTGLKP GTEYTVSIYGVKASEKFIESNPLSAIFTTGGGG SGGGGSGGGGSGGGGSMLPAPKNLVVSRVTE DSARLSWTAPDAAFDSFWITYEEKFYRGEAIV LTVPGSERSYDLTGLKPGTEYKVWIVGVKGG QGSWPLSAIFTT |
| 79 | PRT | Artificial | CR5133 PRASA A6 HC D-AB Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 80 | DNA | Artificial | BC6 | GTGACACGGCGGTTAGAACGCGGCTACAAT TAATACATAACCCCATCCCCCTGTTGACAAT TAATCATCGGCTCGTATAATGTGTGGAATTG TGAGCGGATAACAATTTCACACAGGAAACA GGATCTACCATGCTGCCGGCGCCGAAAAAC CTGGTTGTTTCTGAAGTTACCGAAGACTCTC TGCGTCTGTCTTGGNNNNNNNNNNNNNNNN NNTTYGACTCTTTCCTGATCCAGTACCAGGA ATCTGAAAAAGTTGGTGAAGCGATCAACCT GACCGTTCCGGGTTCTGAACGTTCTTACGAC CTGACCGGTCTGAAACCGGGTACCGAATAC ACCGTTTCTATCTACGGTGTTCTTAGAAGCT TCCCAAAGGC |
| 81 | DNA | Artificial | BC7 | GTGACACGGCGGTTAGAACGCGGCTACAAT TAATACATAACCCCATCCCCCTGTTGACAAT TAATCATCGGCTCGTATAATGTGTGGAATTG TGAGCGGATAACAATTTCACACAGGAAACA GGATCTACCATGCTGCCGGCGCCGAAAAAC CTGGTTGTTTCTGAAGTTACCGAAGACTCTC TGCGTCTGTCTTGGNNNNNNNNNNNNNNNN NNNNTTYGACTCTTTCCTGATCCAGTACCA GGAATCTGAAAAAGTTGGTGAAGCGATCAA CCTGACCGTTCCGGGTTCTGAACGTTCTTAC GACCTGACCGGTCTGAAACCGGGTACCGAA TACACCGTTTCTATCTACGGTGTTCTTAGAA GCTTCCCAAAGGC |
| 82 | DNA | Artificial | BC8 | GTGACACGGCGGTTAGAACGCGGCTACAAT TAATACATAACCCCATCCCCCTGTTGACAAT TAATCATCGGCTCGTATAATGTGTGGAATTG TGAGCGGATAACAATTTCACACAGGAAACA GGATCTACCATGCTGCCGGCGCCGAAAAAC CTGGTTGTTTCTGAAGTTACCGAAGACTCTC TGCGTCTGTCTTGGNNNNNNNNNNNNNNNN NNNNNNNNTTYGACTCTTTCCTGATCCAGT ACCAGGAATCTGAAAAAGTTGGTGAAGCGA TCAACCTGACCGTTCCGGGTTCTGAACGTTC TTACGACCTGACCGGTCTGAAACCGGGTAC |

TABLE 6-continued

Nucleic Acid and Amino Acid Sequences of the Disclosure

| SEQ ID NO: | Type | Species | Description | Sequence |
|---|---|---|---|---|
| | | | | CGAATACACCGTTTCTATCTACGGTGTTCTT AGAAGCTTCCCAAAGGC |
| 83 | DNA | Artificial | BC9 | GTGACACGGCGGTTAGAACGCGGCTACAAT TAATACATAACCCCATCCCCCTGTTGACAAT TAATCATCGGCTCGTATAATGTGTGGAATTG TGAGCGGATAACAATTTCACACAGGAAACA GGATCTACCATGCTGCCGGCGCCGAAAAAC CTGGTTGTTTCTGAAGTTACCGAAGACTCTC TGCGTCTGTCTTGGNNNNNNNNNNNNNNNN NNNNNNNNNNNTTYGACTCTTTCCTGATCC AGTACCAGGAATCTGAAAAAGTTGGTGAAG CGATCAACCTGACCGTTCCGGGTTCTGAAC GTTCTTACGACCTGACCGGTCTGAAACCGG GTACCGAATACACCGTTTCTATCTACGGTGT TCTTAGAAGCTTCCCAAAGGC |
| 84 | DNA | Artificia | 130mer-L17A | CGGCGGTTAGAACGCGGCTACAATTAATAC ATAACCCCATCCCCCTGTTGACAATTAATCA TCGGCTCGTATAATGTGTGGAATTGTGAGC GGATAACAATTTCACACAGGAAACAGGATC TACCATGCTG |
| 85 | DNA | Artificial | POP2222ext | CGG CGG TTA GAA CGC GGC TAC AAT TAA TAC |
| 86 | DNA | Artificial | LS1114 | CCA AGA CAG ACG GGC AGA GTC TTC GGT AAC GCG AGA AAC AAC CAG GTT TTT CGG CGC CGG CAG CAT GGT AGA TCC TGT TTC |
| 87 | DNA | Artificial | LS1115 | CCG AAG ACT CTG CCC GTC TGT CTT GG |
| 88 | DNA | Artificial | LS1117 | CAG TGG TCT CAC GGA TTC CTG GTA CTG GAT CAG GAA AGA GTC GAA |
| 89 | DNA | Artificial | SDG10 | CATGCGGTCTCTTCCGAAAAAGTTGGTGAA GCGATCGTCCTGACCGTTCCGGGT |
| 90 | DNA | Artificial | SDG24 | GGTGGTGAAGATCGCAGACAGCGGGTTAG |
| 91 | DNA | Artificial | SDG28 | AAGATCAGTTGCGGCCGCTAGACTAGAACC GCTGCCACCGCCGGTGGTGAAGATCGCAGA C |
| 92 | PRT | Artificial | TCL19 | LPAPKNLVVSRVTEDSARLSWTAPDAAFDSF<u>XI XYXEXXXX</u>GEAIVLTVPGSERSYDLTGLKPGTE Y<u>X</u>V<u>X</u>I<u>X</u>GVKGG<u>XX</u>S<u>X</u>PLSAIFTT; wherein "X" is an equal mixture of 18 amino acids (no cysteine or methionine) |
| 93 | PRT | Artificial | TCL19 C strand | DSFXIXYXE, wherein "X" is an equal mixture of 18 acids (no cysteine or methionine) |
| 94 | PRT | Artificial | TCL19 F strand | TEYXVXIXGV, wherein "X" is an equal mixture of 18 amino acids (no cysteine or methionine) |
| 95 | PRT | Artificial | TCL19 C strand + CD loop | DSFXIXYXEXXXXGE, wherein "X" is an equal mixture of 18 amino acids (no cysteine or methionine) |
| 96 | PRT | Artificial | TCL19 F strand + FG loop | TEYXVXIXGVKGGXXSX, wherein "X" is an equal mixture of 18 amino acids (no cysteine or methionine) |
| 97 | PRT | Artificial | TCL19 A strand + AB loop + B strand + BC loop | LPAPKXLXVXXVXXXXAXLXWXAPDAAF, wherein "X" is an equal mixture of 18 amino acids (no cysteine or methionine) |

TABLE 6-continued

Nucleic Acid and Amino Acid Sequences of the Disclosure

| SEQ ID NO: | Type | Species | Description | Sequence |
|---|---|---|---|---|
| 98 | PRT | Artificial | TCL19 E strand | XYXLT, wherein "X" is an equal mixture of 18 amino acids (no cysteine or methionine) |
| 99 | PRT | S. aureus | SdgB | MKETAAAKFERQHMDSPDLGTLVPRGSMAM NYFVGNSLGVNLTGIEKAIINRLNLFKEMGRP AQCVFLSWNRYLYRNAQNYITSSDYINMYDF FQEATYLERNEPFDWLSYWTDECHYTLKHV ENSHDFRIYDQERFLMYAHFQDPKYRILDYV NHFDSQRRKVKRDFYDVRGFLSCSRILVDKQ QTLCEFFYNPEDDTKLEKYFSYKDGKPEVQKI IVYYANKQYFFNNETELGAFFIKQLYQHGDL FFSDRNVYTAPIFNLTPESIPVVAVLHSTHIKNI DALDSSPFKNVYKAMFENLSRYRAIIVSTEQQ KLDVEKRINHTIPVVNIPVGYSETIDTPVQTLD QRSVKLISVARYSPEKQLHQQIELIKRLVSYV PKIELHMYGFGSESKKLNELIQKYGLENHVY LRGFLSNLDQEYSDAYLSLITSNMEGFSLALL ESLAHGVPVISYDIKYGPNELITSDFNGYLITK NDEDALFDKVKYVIDHPEVQQRLSKGSLAKA QQYSKASLIKQWDQFVRLILEHHHHHH |
| 100 | PRT | S. aureus | SdrC4 | MAEHTNGELNQSKNETTAPSENKTTKKVDSR QLKDNTQTATADQPKVTMSDSATVKETSSN MQSPQNATANQSTTKTSNVTTNDKSSTTYSN ETDKSNLTQAKDVSTTPKTTTIKPRTLNRMA VNTVAAPQQGTNVNDKVHFSNIDIAIDKGHV NQTTGKTEFWATSSDVLKLKANYTIDDSVKE GDTFTFKYGQYFRPGSVRLPSQTQNLYNAQG NIIAKGIYDSTTNTTTYTFTNYVDQYTNVRGS FEQVAFAKRKNATTDKTAYKMEVTLGNDTY SEEIIVDYGNKKAQPLISSTNYINNEDLSRNMT AYVNQPKNTYTKQTFVTNLTGYKFNPNAKN FKIYEVTDQNQFVDSFTPDTSKLKDVTDQFD VIYSNDNKTATVDLMKGQTSSNKQYIIQQVA YPDNSSTDNGKIDYTLDTDKTKYSWSNSYSN VNGSSTANGDQKKYNLGDYVWEDTNKDGK QDANEKGIKGVYVILKDSNGKELDRTTTDEN GKYQFTGLSNGTYSVEFSTPAGYTPTTANVG TDDAVDSDGLTTTGVIKDADNMTLDSGFYKT PKYSLGDYVWYDSNKDGKQDSTEKGIKGVK VTLQNEKGEVIGTTETDENGKYRFDNLDSGK YKVIFEKPAGLTQTGTNTTEDDKDADGGEVD VTITDHDDFTLDNGYYEEETSDSDSDSDSDSD SDSDSDSDSDSDSDSDSDSDSDSDSDSDSD SDSDSNSDSDSDSDSDSDSDSDSDSDSDSD SDSDSDSDSDSDSDSDSDSDSDSDSDSDSD SDSDSDSDSDSDSDSDSDSDSDSDSDSDSD SDSDSDSDSDSDSDSDNDSDSDSDSDSDA GKHTPAKPMSTVKDQHKTAKALEHHHHHH |
| 101 | PRT | S. aureus | SdrC5 | MTPKYSLGDYVWYDSNKDGKQDSTEKGIKG VKVTLQNEKGEVIGTTETDENGKYRFDNLDS GKYKVIFEKPAGLTQTGTNTTEDDKDADGGE VDVTITDHDDFTLDNGYYEEETSDSDSDSDS DSDSDSDSDSDSDSDSDSDSDSDSDSDSDS DSDSDSDSNSDSDSDSDSDSDSDSDSDSDS DSDSDSDSDSDSDSDSDSDSDSDSDSDSDS DSDSDSDSDSDSDSDSDSDSDSDSDSDSDS DSDSDSDSDSDSDSDSDNDSDSDSDSDS DAGKHTPAKPMSTVKDQHKTAKALPETGLE HHHHHH |
| 102 | PRT | Human | Pagibaximab Heavy Chain | EVMLVESGGGLVQPKGSLKLSCAASGFTFNN YAMNWVRQAPGKGLEWVARIRSKSNNYATF YADSVKDRFTISRDDSQSMLYLQMNNLKTED TAMYYCVRRGASGIDYAMDYWGQGTSLTVS SASTKGPSVFPLAPSSKSTSGGTAALGCLVKD YFPEPVTVSWNSGALTSGVHTPPAVLQSSGL YSLSSVVTVPSSSLGTQTYICNVNHKPSNTKV DKKVEPKSCDKTHTCPPCPAPELLGGPSVFLF PPKPKDTLMISRTPEVTCVVVDVSHEDPEVKF |

TABLE 6-continued

Nucleic Acid and Amino Acid Sequences of the Disclosure

| SEQ ID NO: | Type | Species | Description | Sequence |
|---|---|---|---|---|
| | | | | NWYVDGVEVHNAKTKPREEQYNSTYRVVSV LTVLHQDWLNGKEYKCKVSNKALPAPIEKTI SKAKGQPREPQVYTLPPSRDELTKNQVSLTCL VKGFYPSDIAVEWESNGQPENNYKTTPPVLD SDGSFFLYSKLTVDKSRWQQGNVFSCSVMHE ALHNHYTQKSLSLSPGK |
| 103 | PRT | Human | Pagibaximab Light Chain | DIVLSQSPAILSASPGEKVTMTCRASSSVNYM HWYQQKPGSSPKPWISATSNLASGVPARFSG SGSGTSYSLTISRVEAEDAATYYCQQWSSNPP TFGGGTMLEIKRTVAAPSVFIFPPSDEQLKSGT ASVVCLLNNFYPREAKVQWKVDNALQSGNS QESVTEQDSKDSTYSLSSTLTLSKADYEKHK VYACEVTHQGLSSPVTKSFNRGEC |
| 104 | PRT | Human | CNTO3930 Heavy Chain | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPELLGGPSVFLFPPKPK DTLMISRTPEVTCVVVDVSHEDPEVKFNWYV DGVEVHNAKTKPREEQYNSTYRVVSVLTVL HQDWLNGKEYKCKVSNKALPAPIEKTISKAK GQPREPQVYTLPPSRDELTKNQVSLTCLVKGF YPSDIAVEWESNGQPENNYKTTPPVLDSDGSF FLYSKLTVDKSRWQQGNVFSCSVMHEALHN HYTQKSLSLSPGK |
| 105 | PRT | Human | CNTO3930 Light Chain | DIVMTQSPDSLAVSLGERATINCRASQSVDYN GISYMHWYQQKPGQPPKLLIYAASNPESGVP DRFSGSGSGTDFTLTISSLQAEDVAVYYCQQII EDPWTFGQGTKVEIKRTVAAPSVFIFPPSDEQ LKSGTASVVCLLNNFYPREAKVQWKVDNAL QSGNSQESVTEQDSKDSTYSLSSTLTLSKADY EKHKVYACEVTHQGLSSPVTKSFNRGEC |
| 106 | PRT | Human | CNTO3929 Heavy Chain | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKA EPKSCDKTHTCPPCPAPELLGGPSVFLFPPKPK DTLMISRTPEVTCVVVDVSHEDPEVKFNWYV DGVEVHNAKTKPREEQYNSTYRVVSVLTVL HQDWLNGKEYKCKVSNKALPAPIEKTISKAK GQPREPQVYTLPPSRDELTKNQVSLTCLVKGF YPSDIAVEWESNGQPENNYKTTPPVLDSDGSF FLYSKLTVDKSRWQQGNVFSCSVMHEALHN HYTQKSLSLSPGK |
| 107 | PRT | Human | CNTO3929 Light Chain | DIVMTQSPDSLAVSLGERATINCRASQSVDYN GISYMHWYQQKPGQPPKLLIYAASNPESGVP DRFSGSGSGTDFTLTISSLQAEDVAVYYCQQII EDPWTFGQGTKVEIKRTVAAPSVFIFPPSDEQ LKSGTASVVCLLNNFYPREAKVQWKVDNAL QSGNSQESVTEQDSKDSTYSLSSTLTLSKADY EKHKVYACEVTHQGLSLPVTKSFNRGEC |
| 108 | PRT | S. aureus | HlgA | NSAHHHHHHGSENKIEDIGQGAEIIKRTQDITS KRLAITQNIQFDFVKDKKYNKDALVVKMQG FISSRTTYSDLKKYPYIKRMIWPFQYNISLKTK DSNVDLINYLPKNKIDSADVSQKLGYNIGGNF QSAPSIGGSGSFNYSKTISYNQKNYVTEVESQ NSKGVKWGVKANSFVTPNGQVSAYDQYLFA QDPTGPAARDYFVPDNQLPPLIQSGFNPSFITT LSHERGKGDKSEFEITYGRNMDATYAYVTRH RLAVDRKHDAFKNRNVTVKYEVNWKTHEV KIKSITPK |

TABLE 6-continued

Nucleic Acid and Amino Acid Sequences of the Disclosure

| SEQ ID NO: | Type | Species | Description | Sequence |
|---|---|---|---|---|
| 109 | PRT | S. aureus | HlgB | NSAHHHHHHGSEGKITPVSVKKVDDKVTLY KTTATADSDKFKISQILTFNFIKDKSYDKDTL VLKATGNINSGFVKPNPNDYDFSKLYWGAK YNVSISSQSNDSVNVVDYAPKNQNEEFQVQN TLGYTFGGDISISNGLSGGLNGNTAFSETINYK QESYRTTLSRNTNYKNVGWGVEAHKIMNNG WGPYGRDSFHPTYGNELFLAGRQSSAYAGQ NFIAQHQMPLLSRSNFNPEFLSVLSHRQDGAK KSKITVTYQREMDLYQIRWNGFYWAGANYK NFKTRTFKSTYEIDWENHKVKLLDTKETENNK |
| 110 | PRT | S. aureus | HlgC | NSAHHHHHHGSANDTEDIGKGSDIEIIKRTED KTSNKWGVTQNIQFDFVKDKKYNKDALILK MQGFISSRTTYYNYKKTNHVKAMRWPFQYN IGLKTNDKYVSLINYLPKNKIESTNVSQTLGY NIGGNFQSAPSLGGNGSFNYSKSISYTQQNYV SEVEQQNSKSVLWGVKANSFATESGQKSAFD SDLFVGYKPHSKDPRDYFVPDSELPPLVQSGF NPSFIATVSHEKGSSDTSEFEITYGRNMDVTH AIKRSTHYGNSYLDGHRVHNAFVNRNYTVK YEVNWKTHEIKVKGQN |
| 111 | PRT | S. aureus | LukF-PV | NSAHHHHHHGSAQHITPVSEKKVDDKITLYK TTATSDSDKLKISQILTFNFIKDKSYDKDTLIL KAAGNIYSGYTKPNPKDTISSQFYWGSKYNIS INSDSNDSVNVVDYAPKNQNEEFQVQQTVG YSYGGDINISNGLSGGGNGSKSFSETINYKQE SYRTSLDKRTNFKKIGWDVEAHKIMNNGWG PYGRDSYHSTYGNEMFLGSRQSNLNAGQNFL EYHKMPVLSRGNFNPEFIGVLSRKQNAAKKS KITVTYQREMDRYTNFWNQLHWIGNNYKDE NRATHTSIYEVDWENHTVKLIDTQSKEKNPMS |
| 112 | PRT | S. aureus | LukS-PV | NSAHHHHHHGSDNNIENIGDGAEVVKRTEDT SSDKWGVTQNIQFDFVKDKKYNKDALILKM QGFINSKTTYYNYKNTDHIKAMRWPFQYNIG LKTNDPNVDLINYLPKNKIDSVNVSQTLGYNI GGNFNSGPSTGGNGSFNYSKTISYNQQNYISE VERQNSKSVQWGIKANSFITSLGKMSGHDPN LFVGYKPYSQNPRDYFVPDNELPPLVHSGFN PSFIATVSHEKGSGDTSEFEITYGRNMDVTHA TRRTTHYGNSYLEGSRIHNAFVNRNYTVKYE VNWKTHEIKVKGHN |
| 113 | PRT | Artificial | Luk82 | LPAPKNLVVSRVTEDSARLSWSNRAITTFDSF LIQYQESEKVGEAIVLTVPGSERSYDLTGLKP GTEYTVSIYGVEYRFRPKYTGSNPLSAIFTT |
| 114 | PRT | Artificial | Luk83 | LPAPKNLVVSRVTEDSARLSWFRPSEDISSFD SFLIQYQESEKVGEAIVLTVPGSERSYDLTGL KPGTEYTVSIYGVAFPTDAKSNPLSAIFTT |
| 115 | PRT | Artificial | Luk85 | LPAPKNLVVSRVTEDSARLSWTAPDAAFDSF HINYNEEALVGEAIVLTVPGSERSCDLTGLKP GTEYGVEIEGVKGGPWSWPLSAIFTT |
| 116 | PRT | Artificial | Luk86 | LPAPKNLVVSRVTEDSARLSWTAPDAAFDSF YIRYNEIDLHGEAIVLTVPGSERSYDLTGLKP GTEYQVPIAGVKVCIISKPLSAIFTT |
| 117 | PRT | Artificial | Luk87 | LPAPKNLVVSRVTEDSARLSWANTEPSYFAF DSFLIQYQESEKVGEAIVLTVPGSERSYDLTG LKPGTEYTVSIYGVVWVTWGKSNPLSAIFTT |
| 118 | PRT | Artificial | Luk88 | LPAPKNLVVSRVTEDSARLSWTLEWSLIFDSF LIQYQESEKVGEAIVLTVPGSERSYDLTGLKP GTEYTVSIYGVQRSVAWYFLLLASNPLSAIFTT |
| 119 | PRT | Artificial | Luk90 | LPAPKNLVVSRVTEDSARLSWRTYPTLFDSFL IQYQESEKVGEAIVLTVPGSERSYDLTGLKPG TEYTVSIYGVWPRNIQPWSNPLSAIFTT |

TABLE 6-continued

Nucleic Acid and Amino Acid Sequences of the Disclosure

| SEQ ID NO: | Type | Species | Description | Sequence |
|---|---|---|---|---|
| 120 | PRT | Artificial | Luk92 | LPAPKNLVVSRVTEDSARLSWKRVKWVSYQFDSFLIQYQESEKVGEAIVLTVPGSERSYDLTGLKPGTEYTVSIYGVASIDETVGVSNPLSAIFTT |
| 121 | PRT | Artificial | Luk93 | LPAPKNLVVSRVTEDSARLSWWRRISRFDSFLIQYQESEKVGEAIVLTVPGSERSYDLTGLKPGTEYTVSIYGVDREVYDEWSSNPLSAIFTT |
| 122 | PRT | Artificial | Luk94 | LPAPKNLVVSRVTEDSARLSWYRRFLLFIFFDSFLIQYQESEKVGEAIVLTVPGSERSYDLTGLKPGTEYTVSIYGVGEQWGEASDLSNPLSAIFTT |
| 123 | PRT | Artificial | Luk95 | LPAPKNLVVSRVTEDSARLSWQHSQYFVLFDSFLIQYQESEKVGEAIVLTVPGSERSYDLTGLKPGTEYTVSIYGVLYRQWRDSNPLSAIFTT |
| 124 | PRT | Artificial | Luk96 | LPAPKNLVVSRVTEDSARLSWTAPDAAFDSFLIQYQESEKVGEAIVLTVPGSERSYDLTGLKPGTEYTVSIYGVEHWPSWWHLNFSNPLSAIFTT |
| 125 | PRT | Artificial | Luk97 | LPAPKNLVVSRVTEDSARLSWTAPDAAFDSFLIQYQESEKVGEAIVLTVPGSERSYDLTGLKPGTEYTVSIYGVIDIIHINSWNDHSNPLSAIFTT |
| 126 | PRT | Artificial | Luk98 | LPAPKNLVVSRVTEDSARLSWNRHSHEFDSFLIQYQESEKVGEAIVLTVPGSERSYDLTGLKPGTEYTVSIYGVRIWVLKLNESNPLSAIFTT |
| 127 | PRT | Artificial | Luk99 | LPAPKNLVVSRVTEDSARLSWTAPDAAFDSFEIIYYERHDNGEAIVLTVPGSERSYDLTGLKPGTEYLVWIPGVKGGLTSWPLSAIFTT |
| 128 | PRT | Artificial | Luk100 | LPAPKNLVVSRVTEDSARLSWTAPDAAFDSFPITYGEYRSVGEAIVLTVPGSERSYDLTGLKPGTEYIVDIYGVKGGLFSYPLSAIFTT |
| 129 | PRT | Artificial | Luk101 | LPAPKNLVVSRVTEDSARLSWDTEPEWFDSFLIQYQESEKVGEAIVLTVPGSERSYDLTGLKPGTEYTVSIYGVQRVEIRALYRSYSNPLSAIFTT |
| 130 | PRT | Artificial | Luk102 | LPAPKNLVVSRVTEDSARLSWTAPDAAFDSFLIQYQESEKVGEAIVLTVPGSERSYDLTGLKPGTEYTVSIYGVSHRFWKHVYFYSNPLSAIFTT |
| 131 | PRT | Artificial | Luk103 | LPAPKNLVVSRVTEDSARLSWIIGLSRFDSFLIQYQESEKVGEAIVLTVPGSERSYDLTGLKPGTEYTVSIYGVDFAHQDFFRGYASNPLSAIFTT |
| 132 | PRT | Artificial | Luk104 | LPAPKNLVVSRVTEDSARLSWTAPDAAFDSFLIQYQESEKVGEAIVLTVPGSERSYDLTGLKPGTEYTVSIYGVQWWVAFHHAPSNPLSAIFTT |
| 133 | PRT | Artificial | Luk106 | LPAPKNLVVSRVTEDSARLSWTAPDAAFDSFLIQYQESEKVGEAIVLTVPGSERSYDLTGLKPGTEYTVSIYGVVAWIFTKVLNASNPLSAIFTT |
| 134 | PRT | Artificial | Luk107 | LPAPKNLVVSRVTEDSARLSWKGPNSPPSQFDSFLIQYQESEKVGEAIVLTVPGSERSYDLTGLKPGTEYTVSIYGVWKWRTRAHSNPLSAIFTT |
| 135 | PRT | Artificial | Luk108 | LPAPKNLVVSRVTEDSARLSWFYYYLGKFGFDSFLIQYQESEKVGEAIVLTVPGSERSYDLTGLKPGTEYTVSIYGVVNWRWWPDDSNPLSAIFTT |
| 136 | PRT | Artificial | Luk109 | LPAPKNLVVSRVTEDSARLSWTAPDAAFDSFLIQYQESEKVGEAIVLTVPGSERSYDLTGLKPGTEYTVSIYGVIINRFWAWYLASSNPLSAIFTT |

TABLE 6-continued

Nucleic Acid and Amino Acid Sequences of the Disclosure

| SEQ ID NO: | Type | Species | Description | Sequence |
|---|---|---|---|---|
| 137 | PRT | Artificial | Luk110 | LPAPKNLVVSRVTEDSARLSWTAPDAAFDSF LIQYQESEKVGEAIVLTVPGSERSYDLTGLKP GTEYTVSIYGVGFPTFLNYWQFGSNPLSAIFT T |
| 138 | PRT | Artificial | Luk112 | LPAPKNLVVSRVTEDSARLSWTAPDAAFDSF EIHYYEFRHHGEAIVLTVPGSERSYDLTGLKP GTEYAFWIYGVKGGGSSWPLSAIFTT |
| 139 | PRT | Artificial | Luk113 | LPAPKNLVVSRVTEDSARLSWTAPDAAFDSF WIEYHEEYETGEAIVLTVPGSERSYDLTGLKP GTEYWVWIAGVKGGKWSWPLSAIFTT |
| 140 | PRT | Artificial | Luk114 | LPAPKNLVVSRVTEDSARLSWTAPDAAFDSF EIHYQELPQKGEAIVLTVPGSERSYDLTGLKP GTEYVVWIWGVKGGLTSDPLSAIFTT |
| 141 | PRT | Artificial | Luk116 | LPAPKNLVVSRVTEDSARLSWTAPDAAFDSF EIHYQEYPAFGEAIVLTVPGSERSYDLTGLKP GTEYIVWIWGVKGGWTSWPLSAIFTT |
| 142 | PRT | Artificial | Luk117 | LPAPKNLVVSRVTEDSARLSWTAPDAAFDSF EIHYQETISVGEAIVLTVPGSERSYDLTGLKPG TEYWVLIWGVKGGAASDPLSAIFTT |
| 143 | PRT | Artificial | Luk119 | LPAPKNLVVSRVTEDSARLSWTAPDAAFDSF SIDYFEEYQKGEAIVLTVPGSERSYDLTGLKP GTEYWVWIFGVKGGIRSWPLSAIFTT |
| 144 | PRT | Artificial | Luk120 | LPAPKNLVVSRVTEDSARLSWTAPDAAFDSF EINYWEAYIHGEAIVLTVPGSERSYDLTGLKP GTEYWVWIHGVKGGGNSYPLSAIFTT |
| 145 | PRT | Artificial | Luk122 | LPAPKNLVVSRVTEDSARLSWTAPDAAFDSF EIHYYEFAIKGEAIVLTVPGSERSYDLTGLKPG TEYAVWIYGVKGGNSSWPLSAIFTT |
| 146 | PRT | Artificial | Luk123 | LPAPKNLVVSRVTEDSARLSWTAPDAAFDSF EIDYFEEYSHGEAIVLTVPGSERSYDLTGLKP GTEYWVWINGVKGGIYSYPLSAIFTT |
| 147 | PRT | Artificial | Luk124 | LPAPKNLVVSRVTEDSARLSWTAPDAAFDSF TIDYVESYALGEAIVLTVPGSERSYDLTGLKP GTEYWVWIWGVKGGSLSYPMSAIFTT |
| 148 | PRT | Artificial | Luk125 | LPAPKNLVVSRVTEDSARLSWTAPDAAFDSF PIIYYEHHNFGEAIVLTVPGSERSYDLTGLKPG TEYAVPIPGVKGGWQSLPLSAIFTT |
| 149 | PRT | Artificial | Luk126 | LPAPKNLVVSRVTEDSARLSWTAPDAAFDSF YIDYQEWPSVGEAIVLTVPGSERSYDLTGLKP GTEYSVFIHGVKGGWLSKPLSAIFTT |
| 150 | PRT | Artificial | Luk128 | LPAPKNLVVSRVTEDSARLSWTAPDAAFDSF DIQYFEEYAIGEAIVLTVPGSERSYDLTGLKPG TEYWVWISGVKGGNFSKPLSAIFTT |
| 151 | PRT | Artificial | Luk129 | LPAPKNLVVSRVTEDSARLSWTAPDAAFDSF NINYPEEFHGGEAIVLTVPGSERSYDLTGLKP GTEYEVWIWGVKGGSSSNPLSAIFTT |
| 152 | PRT | Artificial | Luk130 | LPAPKNLVVSRVTEDSARLSWTAPDAAFDSF NIHYLEWEVNGEAIVLTVPGSERSYDLTGLKP GTEYIVEIWGVKGGYSSWPLSAIFTT |
| 153 | PRT | Artificial | Luk132 | LPAPKNLVVSRVTEDSARLSWTAPDAAFDSF YIEYWEWDPVGEAIVLTVPGSERSYDLTGLK PGTEYPVFISGVKGGYPSVPLSAIFTT |
| 154 | PRT | Artificial | Luk133 | LPAPKNLVVSRVTEDSARLSWTAPDAAFDSFI IHYGEGPEFGEAIVLTVPGSERSYDLTGLKPG TEYSVHIPGVKGGWLSWPLSAIFTT |

TABLE 6-continued

Nucleic Acid and Amino Acid Sequences of the Disclosure

| SEQ ID NO: | Type | Species | Description | Sequence |
|---|---|---|---|---|
| 155 | PRT | Artificial | Luk134 | LPAPKNLVVSRVTEDSARLSWTAPDAAFDSF TIVYLEWVVLGEAIVLTVPGSERSYDLTGLKP GTEYIVDIYGVKGGWTSRPLSAIFTT |
| 156 | PRT | Artificial | Luk136 | LPAPKNLVVSRVTEDSARLSWTAPDAAFDSF TIDYFEEYVVGEAIVLTVPGSERSYDLTGLKP GTEYWVCIVGVKGGTPSPPLSAIFTT |
| 157 | PRT | Artificial | Luk138 | LPAPKNLVVSRVTEDSARLSWTAPDAAFDSF HIWYQEFEVRGEAIVLTVPGSERSYDLTGLKP GTEYDVEIWGVKGGHSWTLSAIFTT |
| 158 | PRT | Artificial | Luk139 | LPAPKNLVVSRVTEDSARLSWTAPDAAFNSF EIHYGEWEYGGEAIVLTVPGSERSYDLTGLKP GTEYTVWIYGVKGGDSSWPLSAIFTT |
| 159 | PRT | Artificial | Luk140 | LPAPKNLVVSRVTEDSARLSWTAPDAAFDSF EIHYQETKKSGEAIVLTVPGSERSYDLTGLKP GTEYWVLIWGVKGGTASNPLSAIFTT |
| 160 | PRT | Artificial | Luk143 | LPAPKNLVVSRVTEDSARLSWTAPDAAFDSF DIQYDERTEEGEAIVLTVPGSERSYDLTGLKP GTEYFVTIPGVKGGWYSWPLSAIFTT |
| 161 | PRT | Artificial | Luk144 | LPAPKNLVVSRVTEDSARLSWTAPDAAFDSF WIDYFEEWVNGEAIVLTVPGSERSYDLTGLK PGTEYWVWIQGVKGGVHSPPLSAIFTT |
| 162 | PRT | Artificial | Luk148 | LPAPKNLVVSRVTEDSARLSWTAPDAAFDSF EIHYQELNRVGEAIVLTVPGSERSYDLTGLKP GTEYWVLIWGVKGGDSSEPLSAIFTT |
| 163 | PRT | Artificial | Luk151 | LPAPKNLVVSRVTEDSARLSWTAPDAAFDSF GITYTEVYWWGEAIVLTVPGSERSYDLTGLK PGTEYTVTIPGVKGGWISAPLSAIFTT |
| 164 | PRT | Artificial | Luk155 | LPAPKNLVVSRVTEDSARLSWTAPDAAFDSF SIRYFEFIKPGEAIWLGVPGSERSYDLTGLKPG TEYHVQIRGVKGGRESYPLWADFTT |
| 165 | PRT | Artificial | Luk156 | LPAPKNLVVSRVTEDSARLSWTAPDAAFDSF EIQYHETRYSGEAIWLWVPGSERSYDLTGLK PGTEYSVYIPGVKGGNVSFPLKAHFTT |
| 166 | PRT | Artificial | Luk158 | LPAPKNLVVSRVTEDSARLSWTAPDAAFDSF AISYKESGRIGEAISLIVPGSERSYDLTGLKPG TEYWVYINGVKGGITSFPLNAWFTT |
| 167 | PRT | Artificial | Luk159 | LPAPKNLVVSRVTEDSARLSWTAPDAAFDSF GIDYKETGYTGEAIELEVPGSEHSYDLTGLKP GTEYFVTIGGVKGGYSSWPLVALFTT |
| 168 | PRT | Artificial | Luk160 | LPAPKNLVVSRVTEDSARLSWTAPDAAFDSF VIWYTENPSLGEAIKLSVPGSERSYDLTGLKP GTEYVVEIWGVKGGRGSVPLFAIFTT |
| 169 | PRT | Artificial | Luk163 | LPAPKNLVVSRVTEDSARLSWTAPDAAFDSF YIEYWEPTSDGEAIALNVPGSERSYDLTGLKP GTEYFVEIWGVKGGPRSPPLSAWFTT |
| 170 | PRT | Artificial | Luk164 | LPAPKNLVVSRVTEDSARLSWTAPDAAFDSF DIEYGEPEKIGEAIWLTVPGSERSYDLTGLKP GTEYWVFIYGVKGGALSRPLTATSTT |
| 171 | PRT | Artificial | Luk166 | LPAPKNLVVSRVTEDSARLSWTAPDAAFDSF WIQYFEIQPWGEAILLDVPGSERSYDLTGLKP GTEYSVIIWGVKGGPKSQPLYAWFTT |
| 172 | PRT | Artificial | Luk167 | LPAPKNLVVSRVTEDSARLSWTAPDAAFDSF VIIYSEDTIPGEAIVLWVPGSERSYDLTGLKPG TEYYVQIEGVKGGHESFPLVANFTT |

TABLE 6-continued

Nucleic Acid and Amino Acid Sequences of the Disclosure

| SEQ ID NO: | Type | Species | Description | Sequence |
|---|---|---|---|---|
| 173 | PRT | Artificial | Luk174 | LPAPKNLVVSRVTEDSARLSWTAPDAAFDSF DIEYGEPEKIGEAIWLTVPGSERSYDLTGLKP GTEYWVFIYGVKGGALSRPLTATFTT |
| 174 | PRT | Artificial | Luk176 | LPAPKNLVVSRVTEDSARLSWTAPDAAFDSF VIYYHEFPYGGEAIVLTVPGSERSYDLTGLKP GTEYYVRILGVKGGGLSYPLSAIFTT |
| 175 | PRT | Artificial | Luk177 | LPAPKNLVVSRVTEDSARLSWTAPDAAFDSF AIYYREWGSGEAIVLTVPGSERSYDLTGLKPG TEYLVITGVKGGNPSYPLSAIFTT |
| 176 | PRT | Artificial | Luk178 | LPAPKNLVVSRVTEDSARLSWTAPDAAFDSF AIHYFEAYAGGEAIVLTVPGSERSYDLTGLKP GTEYWVWIFGVKGGLYSYPLSAIFTT |
| 177 | PRT | Artificial | Luk179 | LPAPKNLVVSRVTEDSARLSWTAPDAAFDSF EINYFEAWDGGEAIVLTVPGSERSYDLTGLKP GTEYWVWISGVKGGRYSYPLSAIFTT |
| 178 | PRT | Artificial | Luk180 | LPAPKNLVVSRVTEDSARLSWTAPDAAFDSF EIHYYEPIYVGEAIVLTVPGSERSYDLTGLKPG TEYIVWIYGVKGGYSSWPLSAIFTT |
| 179 | PRT | Artificial | Luk182 | LPAPKNLVVSRVTEDSARLSWTAPDAAFDSF YILYIENDWQGEAIVLTVPGSERSYDLTGLKP GTEYFVVIHGVKGGWISPPLSAIFTT |
| 180 | PRT | Artificial | Luk183 | LPAPKNLVVSRVTEDSARLSWTAPDAAFDSF TIWYWEFLHNGEAIVLTVPGSERSYDLTGLKP GTEYFVEIYGVKGGSVSVPLSAIFTT |
| 181 | PRT | Artificial | Luk184 | LPAPKNLVVSRVTEDSARLSWTAPDAAFDSF TIIYHELNTAGEAIVLTVPGSERSYDLTGLKPG TEYLVIIHGVKGGPISSPLSAIFTT |
| 182 | PRT | Artificial | Luk185 | LPAPKNLVVSRVTEDSARLSWTAPDAAFDSF RIVYREWFHYGEAIVLTVPGSERSYDLTGLKP GTEYYVVIHGVKGGYISKPLSAIFTT |
| 183 | PRT | Artificial | Luk186 | LPAPKNLVVSRVTEDSARLSWTAPDAAFDSF HITYTEYSFVGEAIVLTVPGSERSYDLTGLKP GTEYFVEIYGVKGGFISSPLSAIFTT |
| 184 | PRT | Artificial | Luk187 | LPAPKNLVVSRVTEDSARLSWTAPDAAFDSF RILYFEYKRLGEAIVLTVPGSERSYDLTGLKP GTEYFVGIHGVKGGYISRPLSAIFTT |
| 185 | PRT | Artificial | Luk188 | LPAPKNLVVSRVTEDSARLSWTAPDAAFDSF HIHYWEFNPAGEAIVLTVPGSERSYDLTGLKP GTEYFVGIHGVKGGISWPLSAIFTT |
| 186 | PRT | Artificial | Luk189 | LPAPKNLVVSRVTEDSARLSWTAPDAAFDSL KIFYFEFIYLGEAIVLTVPGSERSYDLTGLKPG TEYHVTIHGVKGGTISLPLSAIFTT |
| 187 | PRT | Artificial | Luk190 | LPAPKNLVVSRVTEDSARLSWTAPDAAFDSF HIFYYEFSNYGEAIVLTVPGSERSYDLTGLKP GTEYFVIIHGVKGGQISVPLSAIFTT |
| 188 | PRT | Artificial | Luk191 | LPAPKNLVVSRVTEDSARLSWTAPDAAFDSF TIFYWEWYHGEAIVLTVPGSERSYDLTGLKP GTEYNVVIHGVKGGYISLPLSAIFTT |
| 189 | PRT | Artificial | Luk192 | LPAPKNLDVSRVTEDSARLSWTAPDAAFDSF VIFYYEEKPIGEAIVLTVPGSERSYDLTGLKPG TEYFVEIYGVKGGYISNPLSAIFTT |
| 190 | PRT | Artificial | Luk193 | LPAPKNLVVSRVTEDSARLSWTAPDAAFDSF NIFYHETRPLGEAIVLTVPGSERSYDLTGLKP GTEYLVAIYGVKGGYISLPLSAIFTT |

TABLE 6-continued

Nucleic Acid and Amino Acid Sequences of the Disclosure

| SEQ ID NO: | Type | Species | Description | Sequence |
|---|---|---|---|---|
| 191 | PRT | Artificial | Luk194 | LPAPKNLVVSRVTEDSARLSWTAPDAAFDSF TIHYWEFSDNGEAIVLTVPGSERSYDLTGLKP GTEYLVGIYGVKGGQISQPLSAIFTT |
| 192 | PRT | Artificial | Luk195 | LPAPKNLVVSRVTEDSARLSWTAPDAAFDSF HIIYYEYPAGGEAIVLTVPGSERSYDLTGLKP GTEYHVIIHGVKGGFVSVPLSAIFTT |
| 193 | PRT | Artificial | Luk196 | LPAPKNLVVSRVTEDSARLSWTAPDAAFDSF NIIYIENPYWGEAIVLTVPGSERSYDLTGLKPG TEYFVIIHGVKGGYISEPLSAIFTT |
| 194 | PRT | Artificial | Luk197 | LPAPKNLVVSRVTEDSARLSWTAPDAAFDSF TILYWEVQANGEAIVLTVPGSERSYDLTGLKP GTEYVVGIYGVKGGYISLPLSAIFTT |
| 195 | PRT | Artificial | Luk198 | LPAPKNLVVSRVTEDSARLSWTAPDAAFDSF QIFYTEEKTWGEAIVLTVPGSERSYDLTGLKP GTEYFVWIHGVKGGWISAPLSAIFTT |
| 196 | PRT | Artificial | Luk199 | LPAPKNLVVSRVTEDSARLSWTAPDAAFDSF TILYAEHSNKGEAIVLTVPGSERSYDLTGLKP GTEYFVGIYGVKGGFISWPLSAIFTT |
| 197 | PRT | Artificial | Luk201 | LPAPKNLVVSRVTEDSARLSWTAPDAAFDSF TIFYLEHNDEGEAIVLTVPGSERSYDLTGLKP GTEYWVAIHGVKGGYISQPLSAIFTT |
| 198 | PRT | Artificial | Luk202 | LPAPKNLVVSRVTEDSARLSWTAPDAAFDSF RIWYHETWRGEAIVLTVPGSERSYDLTGLKP GTEYPVVIHGVKGGFISTPLSAIFTT |
| 199 | PRT | Artificial | Luk203 | LPAPKNLVVSRVTEDSARLSWTAPDAAFDSF TIIYVEYETWGEAIVLTVPGSERSYDLTGLKP GTEYIVAIHGVKGGYISIPLSAIFTT |
| 200 | PRT | Artificial | Luk204 | LPAPKNLVVSRVTEDSARLSWTAPDAAFDSF PIIYWELWSIGEAIVLTVPGSERSYDLTGLKPG TEYFVEIYGVKGGTISTPLSAIFTT |
| 201 | PRT | Artificial | Luk205 | LPAPKNLVVSRVTEDSARLSWTAPDAAFDSF SILYWEWVANGEAIVLTVPGSERSYDLTGLK PGTEYFVEIYGVKGGWLSLPLSAIFTT |
| 202 | PRT | Artificial | Luk206 | LPAPKNLVVSRVTEDSARLSWTAPDAAFDSF AIFYFEQFSRGEAIVLTVPGSERSYDLTGLKPG TEYFVAIHGVKGGFVSRPLSAIFTT |
| 203 | PRT | Artificial | Luk208 | LPAPKNLVVSRVTEDSARLSWTAPDAAFDSF TIWYWEWYHLGEAIVLTVPGSELSYDLTGLK PGTEYWVEIYGVKGGFISQPLSAIFTT |
| 204 | PRT | Artificial | Luk210 | LPAPKNLVVSRVTEDSARLSWTAPDAAFDSF PIFYFEYLGNGEAIVLTVPGSERSYDLTGLKP GTEYFVGIHGVKGGVISTPLSAIFTT |
| 205 | PRT | Artificial | Luk211 | LPAPKNLVVSRVTEDSARLSWTAPDAAFDSF TIIYFEWKRLGEAIVPTVPGSERSYDLTGLKPG TEYWVGIYGVKGGPISVPLSAIFTT |
| 206 | PRT | Artificial | Luk212 | LPAPKNLVVSRVTEDSARLSWTAPDAAFDSF TILYTEREFYGEAIVLTVPGSERSYDLTGLKPG TEYWVGIYGVKGGNISEPLSAIFTT |
| 207 | PRT | Artificial | Luk213 | LPAPKNLVVSRVTEDSARLSWTAPDAAFDSF HIFYHETDAYGEAIVLTVPGSERSYDLTGLKP GTEYFVVIHGVKGGFISSPLSAIFTT |
| 208 | PRT | Artificial | Luk214 | LPAPKNLVVSRVTEDSARLSWTAPDAAFDSF AIHYWEYDANGEAIVLTVPGSERSYDLTGLK PGTEYLVAIYGVKGGLISVPLSAIFTT |

TABLE 6-continued

Nucleic Acid and Amino Acid Sequences of the Disclosure

| SEQ ID NO: | Type | Species | Description | Sequence |
|---|---|---|---|---|
| 209 | PRT | Artificial | Luk215 | LPAPKNLVVSRVTEDSARLSWTAPDAAFDSF TILYHESVTNGEAIVLTVPGSERSYDLTGLKP GTEYLVGIYGVKGGYISDPLSAIFTT |
| 210 | PRT | Artificial | Luk216 | LPAPKNLVVSRVTEDSARLSWTAPDAAFDSF RIHYFEESITGEAIVLTVPGSERSYDLTGLKPG TEYFVAIYGVKGGSISDPLSAIFTT |
| 211 | PRT | Artificial | Luk218 | LPAPKNLVVSRVTEDSARLSWTAPDAAFDSF SIIYWEYRWQGEAIVLTVPGSERSYDLTGLKP GTEYIVPIHGVKGGEISPPLSAIFTT |
| 212 | PRT | Artificial | Luk219 | LPAPKNLVVSRVTEDSARLSWTAPDAAFDSF TIWYWVYRTSGEAIVLTVPGSERSYDLTGLK PGTEYFVAIHGVKGGEISVPLSAIFTT |
| 213 | PRT | Artificial | Luk220 | LPAPKNLVVSRVTEDSARLSWTAPDAAFDSF AIFYWEESPPGEAIVLTVPGSERSYDLTGLKP GTEYLVAIYGVKGGYISLPLSAIFTT |
| 214 | PRT | Artificial | Luk221 | LPAPKNLVVSRVTEDSARLSWTAPDAAFDSF AIFYHELEHHGEAIVLTVPGSERSYDLTGLKP GTEYFVAIHGVKGGQISWPLSAIFTT |
| 215 | PRT | Artificial | Luk222 | LPAPKNLVVSRVTEDSARLSWTAPDAAFDSF SILYWEEEFGEAIVLTVPGSERSYDLTGLKPG TEYFVAIHGVKGGYISRPLSAIFTT |
| 216 | PRT | Artificial | Luk223 | LPAPKNLVVSRVTEDSARLSWTAPDAAFDSF VILYWEEENQGEAIVLTVPGSERSYDLTGLKP GTEYFVAIHGVKGGHISEPLSAIFTT |
| 217 | PRT | Artificial | Luk224 | LPAPKNLVVSRVTEDSARLSWTAPDAAFDSF TIFYTEHGVSGEAIVLTVPGSERSYDLTGLKP GTEYWVPIHGVKGGTISQPLSAIFTT |
| 218 | PRT | Artificial | Luk225 | LPAPKNLVVSRVTEDSARLSWTAPDAAFDSF QIFYHEFLTIGEAIVLTVPGSERSYDLTGLKPG TEYIVAIYGVKGGQISDPLSAIFTT |
| 219 | PRT | Artificial | Luk226 | LPAPKNLVVSRVTEDSARLSWTAPDAAFDSF TIHYAEWHLDGEAIVLTVPGSERSYDLTGLKP GTEYFVAIHGVKGGYISEPLSAIFTT |
| 220 | PRT | Artificial | Luk227 | LPAPKNLVVSRVTEDSARLSWTAPDAAFDSF RIYYHEWQATGEAIVLTVPGSERSYDLTGLKP GTEYLVVIHGVKGGWISSPLSAIFTT |
| 221 | PRT | Artificial | Luk228 | LPAPKNLVVSRVTEDSARLSWTAPDAAFDSF TIPYYEYAVFGEATVLTVPGSERSYDLTGLKP GTEYHVIIHGVKGGYISLPLSAIFTT |
| 222 | PRT | Artificial | Luk229 | LPAPKNLVVSRVTEDSARLSWTAPDAAFDSF YIFYLEWNQIGEAIVLTVPGSERSYDLTGLKP GTEYFVAIYGVKGGFISDPLSAIFTT |
| 223 | PRT | Artificial | Luk230 | LPAPKNLVVSRVTEDSARLSWTAPDAAFDSFI IFYTESHFYGEAIVLTVPGSERSYDLTGLKPGT EYWVAIYGVKGGEFSFPLSAIFTT |
| 224 | PRT | Artificial | Luk231 | LPAPKNLVVSRVTEDSARLSWTAPDAAFDSF RILYWEYVTAGEAIVLTVPGSERSYDLTGLKP GTEYFVVIHGVKGGYISIPLSAIFTT |
| 225 | PRT | Artificial | Luk233 | LPAPKNLVVSRVTEDSACLSWTAPDAAFDSF AIQYWEYSGIGEAIVLTVPGSERSYGLTGLKP GTEYFVGIAGVKGGWISLPLSAIFTT |
| 226 | PRT | Artificial | Luk235 | LPAPKNLVVSRVTEDSARLSWTAPDAAFDSF SIIYHEWDKNGEAIVLTVPGSERSYDLTGLKP GTEYFVAIYGVKGGYISRPLSAIFTT |

TABLE 6-continued

Nucleic Acid and Amino Acid Sequences of the Disclosure

| SEQ ID NO: | Type | Species | Description | Sequence |
|---|---|---|---|---|
| 227 | PRT | Artificial | Luk236 | LPAPKNLVVSRVTEDSARLSWTAPDAAFDSF NIFYWEYILPGEAIVLTVPGSERSYDLTGLKP GTEYWVIIHGVKGGHISDPLSAIFTT |
| 228 | PRT | Artificial | Luk237 | MLPPPKNLVVSRVTEDSARLSWTAPDAAFDS FQIIYWEYAETGEAIVLTVPGSERSYDLTGLK PGTEYIVIIHGVKGGEISRPLSAIFTT |
| 229 | PRT | Artificial | Luk238 | LPAPKNLVVSRVTEDSARLSWTAPDAAFDSF AIFYHETVKSGEAIVLTVPGSERSYDLTGLKP GTEYFVVIHGVKRGQISEPLSAIFTT |
| 230 | PRT | Artificial | Luk239 | LPAPKNLVVSRVTEDSARLSWTAPDAAFDSF HISYWEYAVYGEAIVLTVPGSERSYDLTGLKP GTEYFVGIYGVKGGWISSPLSAIFTT |
| 231 | PRT | Artificial | Luk240 | LPAPKNLVVSRVTEDSARLSWTAPDAAFDSF PIFYDEEAHNGEAIVLTVPGSERSYDLTGLKP GTEYFVVIHGVKGGTISIPLSAIFTT |
| 232 | PRT | Artificial | Luk241 | LPAPKNLVVSRVTEDSARLSWTAPDAAFDSF TIYYFESYAVGEAIVLTVPGSERSYDLTGLKP GTEYFVAIYGVKGGWISWPLSAIFTT |
| 233 | PRT | Artificial | Luk242 | LPAPKNLVVSRVTEDSARLSWTAPDAAFDSF VIFYHETEVDGEAIVLTVPGSERSYDLTGLKP GTEYVVIIHGVKGGFISYPLSAIFTT |
| 234 | PRT | Artificial | Luk243 | LPAPKNLVVSRVTEDSARLSWTAPDAAFDSF QIMYFEFQALGEAIVLTVPGSERSYDLTGLKP GTEYLVLIHGVKGGLISPPLSAIFTT |
| 235 | PRT | Artificial | Luk244 | LPAPKNLVVSRVTEDSARLSWTAPDAAFDSF NIYYWEFLENGEAIVLTVPGSERSYDLTGLKP GTEYFVAIHGVKGGFISWPLSAIFTT |
| 236 | PRT | Artificial | Luk245 | LPAPKNLVVSRVTEDSARLSWTAPDAAFDSF TIHYWEFRPGGEAIVLTVPGSERSYDLTGLKP GTEYFVAIFGVKGGSISVPLSAIFTT |
| 237 | PRT | Artificial | Luk246 | LPAPKNLVVSRVTEDSARLSWTAPDAAFDSF VIHYFEASPPGEAIVLTVPGSERSYDLTGLKPG TEYYVVIYGVKGGYISPPLSAIFTT |
| 238 | PRT | Artificial | Luk247 | LPAPKNLVVSRVTEDSARLSWTAPDAAFDSF TIFYHEYVQVGEAIVLTVPGSERSYDLTGLKP GTEYFVAIYGVKGGQISDPLSAIFTT |
| 239 | PRT | Artificial | Luk248 | LPAPKNLVVSRVTEDSARLSWTAPDAAFDSF NIIYWEYVDVGEAIVLTVPGSERSYDLTGLKP GTEYLVPIYGVKGGLISEPLSAIFTT |
| 240 | PRT | Artificial | Luk249 | LPAPKNLVVSRVTEDSARLSWTAPDAAFDSF AIVYWEQKFYGEAIVLTVPGSERSYDLTGLKP GTEYFVGIYGVKGGFISLPLSAIFTT |
| 241 | PRT | Artificial | Luk250 | LPAPKNLVVSRVTEDSARLSWTAPDAAFDSF VIFYDEWRGVGEAIVLTVPGSERSYDLTGLKP GTEYFVPIQGVKGGYVSDPLSAIFTT |
| 242 | PRT | Artificial | Luk251 | LPAPKNLVVSRVTEDSARLSWTAPDAAFDSF AIHYHEYQQIGEAIVLTVPGSERSYDLIGLKPG TEYFVAIYGVKGGFISQPLSAIFTT |
| 243 | PRT | Artificial | Luk252 | LPAPKNLVVSRVTEDSARLSWTAPDAAFDSF AIFYLEWPAKGEAIVLTVPGSERSYDLTGLKP GTEYFVVIHGVKGGWISPPLSAIFTT |
| 244 | PRT | Artificial | Luk253 | LPAPKNLVVSRVTEDSARLSWTAPDAAFDSF NIVYWEYNPVGEAIVLTVPGSERSYDLTGLKP GTEYFVGIYGVKGGNISKPLSAIFTT |

TABLE 6-continued

Nucleic Acid and Amino Acid Sequences of the Disclosure

| SEQ ID NO: | Type | Species | Description | Sequence |
|---|---|---|---|---|
| 245 | PRT | Artificial | Luk254 | LPAPKNLVVSRVTEDSARLSWTAPDAAFDSF GIFYLEHDWRGEAIVLTVPGSERSYDLTGLKP GTEYLVIIHGVKGGSISVPLSAIFTT |
| 246 | PRT | Artificial | Luk255 | LPAPKNLVVSRVTEDSARLSWTAPDAAFDSF TILYWEYEQQGEAIVLTVPGSERSYDLTGLKP GTEYFVAIHGVKGGEISQPLSAIFTT |
| 247 | PRT | Artificial | Luk257 | LPAPKNLVVSRVTEDSARLSWTAPDAAFDSF TIIYIEHVDWGEAIVLTVPGSERSYDLTGLKPG TEYFVEIYGVKGGKISAPLSAIFTT |
| 248 | PRT | Artificial | Luk258 | LPAPKNLVVSRVTEDSARLSWTAPDAAFDSF TIYYFESVDWGEAIVLTVPGSERSYDLTGLKP GTEYYVYIYGVKGGWISVPLSAIFTT |
| 249 | PRT | Artificial | Luk259 | LPAPKNLVVSRVTEDSARLSWTAPDAAFDSF QIIYWESQYWGEAIVLTVPGSERSYDLTGLKP GTEYIVVIHGVKGGGISDPLSAIFTT |
| 250 | PRT | Artificial | Luk260 | LPAPKNLVVSRVTEDSARLSWTAPDAAFDSF RIIYYEWESAGEAIVLTVPGSERSYDLTGLKP GTEYFVAIHGVKGGFISFPLSAIFTT |
| 251 | PRT | Artificial | Luk261 | LPAPKNLVVSRVTEDSARLSWTAPDAAFDSF NIFYWEFQKKGEAIVLTVPGSERSYDLTGLKP GTEYIVIIYGVKGGFISPPLSAIFTT |
| 252 | PRT | Artificial | Luk262 | LPAPKNLVVSRVTEDSARLSWTAPDAAFDSF HIFYLEKTNYGEAIVLTVPGSERSYDLTGLKP GTEYLVIIHGVKGGPISGPLSAIFTT |
| 253 | PRT | Artificial | Luk263 | LPAPKNLVVSRVTEDSARLSWTAPDAAFDSF GIWYWEYVRNGEAIVLTVPGSERSYDLTGLK PGTEYFVPIYGVKGGDTSPPLSAIFTT |
| 254 | PRT | Artificial | Luk264 | LPAPKNLVVSRVTEDSARLSWTAPDAAFDSF VIFYHEYFTVGEAIVLTVPGSERSYDLTGLKP GTEYFVAIHGVKGGLISAPLSAIFTT |
| 255 | PRT | Artificial | Luk265 | LPAPKNLVVSRVTEDSARLSWTAPDAAFDSF QIIYFENEYGGEAIVLTVPGSERSYDLTGLKPG TEYFVAIYGVKGGYLSVPLSAIFTT |
| 256 | PRT | Artificial | Luk266 | LPAPKNLVVSRVTEDSARLSWTAPDAAFDSF RIGYLENPWDGEAIVLTVPGSERSYDLTGLKP GTEYFVFIYGVKGGHISNPLSAIFTT |
| 257 | PRT | Artificial | Luk267 | LPAPKNLVVSRVTEDSARLSWTAPDAAFDSFI IHYFEYEPPGEAIVLTVPGSERSYDLTGLKPGT EYFVGIYGVKGGWVSEPLSAIFTT |
| 258 | PRT | Artificial | Luk268 | LPAPKNLVVSRVTEDSARLSWTAPDAAFDSF TIFYPEYSARGEAIVLTVPGSERSYDLTGLKPG TEYFVVIHGVKGGFVSEPLSAIFTT |
| 259 | PRT | Artificial | Luk269 | LPAPKNLVVSRVTEDSARLSWTAPDAAFDSF NIIYWEYEVAGEAIVLTVPGSERSYDLTGLKP GTEYFVSIQGVKGGAISPPLSAIFTT |
| 260 | PRT | Artificial | Luk270 | LPAPKNLVVSRVTEDSARLSWTAPDAAFDSF QIVYFEHPSYGEAIVLTVPGSERSYDLTGLKP GTEYFVGIYGVKGGEISAPLSAIFTT |
| 261 | PRT | Artificial | Luk271 | LPAPKNLVVSRVTEDSARLSWTAPDAAFDSF NIVYFEWAANGEAIVLTVPGSERSYDLTGLKP GTEYFVGIYGVKGGAISLPLSAIFTT |
| 262 | PRT | Artificial | Luk272 | LPAPKNLVVSRVTEDSARLSWTAPDAAFDSF NIFYWEDTLKGEAIVLTVPGSERSYDLTGLKP GTEYVVAIHGVKGGTISHPLSAIFTT |

TABLE 6-continued

Nucleic Acid and Amino Acid Sequences of the Disclosure

| SEQ ID NO: | Type | Species | Description | Sequence |
|---|---|---|---|---|
| 263 | PRT | Artificial | Luk273 | LPAPKNLVVSRVTEDSARLSWTAPDAAFDSF VINYWEFQPAGEAIVLTVPGSERSYDLTGLKP GTEYFVAIHGVKGGQISKPLSAIFTT |
| 264 | PRT | Artificial | Luk274 | LPAPKNLVVSRVTEDSARLSWTAPDAAFDSF TIIYWELVWNGEAIVLTVPGSERSYDLTGLKP GTEYCVPIHGVKGGLISPPLSAIFTT |
| 265 | PRT | Artificial | Luk275 | LPAPKNLVVSRVTEDSARLSWTAPDAAFDSF VIFYEEWQVGGEAIVLTVPGSERSYDLTGLKP GTEYFVAIYGVKGGAISQPLSAIFTT |
| 266 | PRT | Artificial | Luk276 | LPAPKNLVVSRVTEDSARLSWTAPDAAFDSF YIHYFEYEIRGEAIVLTVPGSERSYDLTGLKPG TEYFVSIYGVKGGLISSPLSAIFTT |
| 267 | PRT | Artificial | Luk277 | LPAPKNLVVSRVTEDSARLSWTAPDAAFDSF TIFYLEYDQGEAIVLTVPGSERSYDLTGLKP GTEYLVTIHGVKGGYISEPLSAIFTT |
| 268 | PRT | Artificial | Luk278 | LPAPKNLVVSRVTEDSARLSWTAPDAAFDSF PIFYWEFAVSGEAIVLTVPGSERSYDLTGLKP GTEYSVVIHGVKGGVISEPLSAIFTT |
| 269 | PRT | Artificial | Luk279 | LPAPKNLVVSRVTEDSARLSWTAPDAAFDSF QIIYFEFFIGGEAIVLTVPGSERSYDLTGLKPGT EYFVVIHGVKGGDLSAPLSAIFTT |
| 270 | PRT | Artificial | Luk280 | LPAPKNLVVSRVTEDSARLSWTAPDAAFDSF SIIYWEFASNGEAIVLTVPGSERSYDLTGLKPG TEYFVAIYGVKGGEISNPLSAIFTT |
| 271 | PRT | Artificial | Luk281 | LPAPKNLVVSRVTEDSARLSWTAPDAAFDSF TIFYFEFQTHGEAIVLTVPGSERSYDLTGLKPG TEYFVPITGVKGGWYSDPLSAIFTT |
| 272 | PRT | Artificial | Luk282 | LPAPKNLVVSRVTEDSARLSWTAPDAAFDSFI IIYWEYRTCGEAIVLTVPGSERSYDLTGLKPG TEYFVEIYGVKGGNTSPPLSAIFTT |
| 273 | PRT | Artificial | Luk283 | LPAPKNLVVSRVTEDSARLSWTAPDAAFDSIT IHYFEPHTGGEAIVLTVPGSERSYDLTGLKPG TEYFVPIYGVKGGYISQPLSAIFTT |
| 274 | PRT | Artificial | Luk285 | LPAPKNLVVSRVTEDSARLSWTAPDAAFDSF PILYWENITTGEAIVLTVPGSERSYDLTGLKPG TEYFVVIHGVKGGFISGPLSAIFTT |
| 275 | PRT | Artificial | Luk286 | LPAPKNLVVSRVTEDSARLSWTAPDAAFDSF PIFYWEFQAAGEAIVLTVPGSERSYDLTGLKP GTEYFVEIYGVKGGWTSFPLSAIFTT |
| 276 | PRT | Artificial | Luk287 | LPAPKNLVVSRVTEDSARLSWTAPDAAFDSF VIVYWEWQCNGEAIVLTVPGSERSYDLTGLK PGTEYFVFIHGVKGGITSAPLSAIFTT |
| 277 | PRT | Artificial | Luk288 | LPAPKNLVVSRVTEDSARLSWTAPDAAFDSF AIHYWEPQGIGEAIVLTVPGSERSYDLTGLKP GTEYFVGIHGVKGGWISFPLSAIFTT |
| 278 | PRT | Artificial | Luk289 | LPAPKNLVVSRVTEDSARLSWTAPDAAFDSFI IPYWEYQYAGEAIVLTVPGSERSYDLTGLKPG TEYWVGIYGVKGGSISEPLSAIFTT |
| 279 | PRT | Artificial | Luk290 | LPAPKNLVVSRVTEDSARLSWTAPDAAFDSF TIFYIEPQFEGEAIVLTVPGSERSYDLTGLKPG TEYIVVIHGVKGGYISKPLSAIFTT |
| 280 | PRT | Artificial | Luk291 | LPAPKNLVVSRVTEDSARLSWTAPDAAFDSF NIIYWEYDPHGEAIVLTVPGSERSYDLTGLKP GTEYIVSIYGVKGGYISPPLSAIFTT |

TABLE 6-continued

Nucleic Acid and Amino Acid Sequences of the Disclosure

| SEQ ID NO: | Type | Species | Description | Sequence |
|---|---|---|---|---|
| 281 | PRT | Artificial | Luk292 | LPAPKNLVVSRVTEDSARLSWTAPDAAFDSF AIEYWEWIDKGEAIVLTVPGSERSYDLTGLKP GTEYFVGIYGVKGGYISWPLSAIFTT |
| 282 | PRT | Artificial | Luk293 | LPAPKNLVVSRVTEDSARLSWTAPDAAFDSF SILYHEWSGWGEAIVLTVPGSERSYDLTGLKP GTEYFVFIHGVKGGYISPPLSAIFTT |
| 283 | PRT | Artificial | Luk294 | LPAPKNLVVSRVTEDSARLSWTAPDAAFDSF QILYWETAKSGEAIVLTVPGSERSYDLTGLKP GTEYFVEIYGVKGGWISWPLSAIFTT |
| 284 | PRT | Artificial | Luk296 | LPAPKNLVVSRVTEDSARLSWTAPDAAFDSF TIHYYEFKYQGEAIVLTVPGSERSYDLTGLKP GTEYFVVIHGVKGGFISPPLSAIFTT |
| 285 | PRT | Artificial | Luk298 | LPAPKNLVVSRVTEDSARLSWTAPDAAFDSF TIIYLEGNWSGEAIVLTVPGSERSYDLTGLKP GTEYFVSIYGVKGGFISEPLSAIFTT |
| 286 | PRT | Artificial | Luk299 | LPAPKNLVVSRVTEDSARLSWTAPDAAFDSF KIFYWEWPHSGEAIVLTVPGSERSYDLTGLKP GTEYFVAIHGVKGGWISKPLSAIFTT |
| 287 | PRT | Artificial | Luk300 | LPAPKNLVVSRVTEDSARLSWTAPDAAFDSF TISYWEYAGYGEAIVLTVPGSERSYDLTGLKP GTEYFVGIHGVKGGWISKPLSAIFTT |
| 288 | PRT | Artificial | Luk301 | LPAPKNLVVSRVTEDSARLSWTAPDAAFDSF HISYWEYYARGEAIVLTVPGSERSYDLTGLKP GTEYFVGIYGVKGGVISPPLSAIFTT |
| 289 | PRT | Artificial | Luk302 | LPAPKNLVVSRVTEDSARLSWTAPDAAFDSF KIWYLETGFRGEAIVLTVPGSERSYDLTGLKP GTEYFVPIYGVKGGYISQPLSAIFTT |
| 290 | PRT | Artificial | Luk303 | LPAPKNLVVSRVTEDSARLSWTAPDAAFDSF NIQYWEWNLGGEAIVLTVPGSERSYDLTGLK PGTEYFVAIYGVKGGAISDPLSAIFTT |
| 291 | PRT | Artificial | Luk304 | LPAPKNLVVSRVTEDSARLSWTAPDAAFDSF WIGYTELYEFGEAISLLVPGSERSYDLTGLKP GTEYSVAIAGVKGGAYSHPLHALFTT |
| 292 | PRT | Artificial | Luk305 | LPAPKNLVVSRVTEDSARLSWTAPDAAFDSF YIKYAEHVVWGEAIDLLVPGSERSYDLTGLK PGTEYEVGIAGVKGGTVSVPLSARFTT |
| 293 | PRT | Artificial | Luk306 | LPAPKNLVVSRVTEDSARLSWTAPDAAFDSFI ILYDEIWPSGEAISLGVPGSERSYDLTGLKPGT EYFVAIHGVKGGNISDPLDAKFTT |
| 294 | PRT | Artificial | Luk307 | LPAPKNLVVSRVTEDSARLSWTAPDAAFDSF WIGYTESRYYGEAIDLLVPGSERSYDLTGLKP GTEYHVRISGVKGGAFSTPLWAAATT |
| 295 | PRT | Artificial | Luk308 | LPAPKNLVVSRVTEDSARLSWTAPDAAFDSF WIGYGERLRFGEAIDLLVPGSERSYDLTGLKP GTEYHVGISGVKGGWFSNPLRAIFTT |
| 296 | PRT | Artificial | Luk309 | LPAPKNLVVSRVTEDSARLSWTAPDAAFDSF KIFYLESDWEGEAIALWVPGSERSYDLTGLKP GTEYFVFIHGVKGGYISIPLHANFTT |
| 297 | PRT | Artificial | Luk310 | LPAPKNLVVSRVTEDSARLSWTAPDAAFDSF WIGYTETAKWGEAITLLVPGSERSYDLTGLK PGTEYRVGIGGVKGGGWSWPLDAIFTT |
| 298 | PRT | Artificial | Luk311 | LPAPKNLVVSRVTEDSARLSWTAPDAAFDSF WISYVEPDDGEAIELLVPGSERSYDLTGLKPG TEYIVQIDGVKGGTTSVPLNARFTT |

TABLE 6-continued

Nucleic Acid and Amino Acid Sequences of the Disclosure

| SEQ ID NO: | Type | Species | Description | Sequence |
|---|---|---|---|---|
| 299 | PRT | Artificial | Luk312 | LPAPKNLVVSRVTEDSARLSWTAPDAAFDSF WIGYSEYPEYGEAIDLVVPGSERSYDLTGLKP GTEYRVGITGVKGGWISKPLNATFTT |
| 300 | PRT | Artificial | Luk313 | LPAPKNLVVSRVTEDSARLSWTAPDAAFDSF WIGYNEIGKWGEAIDLIVPGSERSYDLTGLKP GTEYAVGIDGVKGGSISEPLPASFTT |
| 301 | PRT | Artificial | Luk314 | LPAPKNLVVSRVTEDSARLSWTAPDAAFDSF AIFYTEFNFKGEAIPLDVPGSERSYDLTGLKPG TEYFVSIHGVKGGEISPPLEALFTT |
| 302 | PRT | Artificial | Luk315 | LPAPKNLVVSRVTEDSARLSWTAPDAAFDSF WISYQEPDEIGEAIELIVPGSERSYDLTGLKPG TEYFVQIDGVKGGTWSIPLNAYFTT |
| 303 | PRT | Artificial | Luk317 | LPAPKNLVVSRVTEDSARLSWTAPDAAFDSF WIGYHEPTWGEAIDLLVPGSERSYDLTGLKP GTEYQVRISGVKGGTTSQPLQAAAT |
| 304 | PRT | Artificial | Luk318 | LPAPKNLVVSRVTEDSARLSWTAPDAAFDSF WIGYHETVGFGEAIALLVPGSERSYDLTGLKP GTEYAVAIDGVKGGWFSHPLVAYFTT |
| 305 | PRT | Artificial | Luk319 | LPAPKNLVVSRVTEDSARLSWTAPDAAFDSF WIGYFERFNWGEAIDLLVPGSERSYDLTGLKP GTEYQVQIDGVKGGDISIPLSARFTT |
| 306 | PRT | Artificial | Luk320 | LPAPKNLVVSRVTEDSARLSWTAPDAAFDSF WIGYSEWEQLGEAIDLIVPGSERSYDLTGLKP GTEYQVGIAGVKGGSSSFPLGAEFTT |
| 307 | PRT | Artificial | Luk321 | LPAPKNLVVSRVTEDSARLSWTAPDAAFDSF WIGYQEAATWGEAIDLSVPGSERSYDLTGLK PGTEYHVGIVGVKGGGVSTPLVAPFTT |
| 308 | PRT | Artificial | Luk322 | LPAPKNLVVSRVTEDSARLSWTAPDAAFDSF WIGYYESHRGGEAIDLLVPGSERSYDLTGLKP GTEYTVGITGVKGGTISYPLHAIFTT |
| 309 | PRT | Artificial | Luk323 | LPAPKNLVVSRVTEDSARLSWTEPDAAFDSF WIAYPEPGFQGEAISLLVPGSERSYDLTGLKP GTEYEVQIAGVKGGHVSWPLVATFTT |
| 310 | PRT | Artificial | Luk324 | LPAPKNLVVSRVTEDSARLSWTAPDAAFDSF WIAYEEVRAEGEAIELLVPGSERSYDLTGLKP GTEYVVGIDGVKGGGFSSPLVAHFTT |
| 311 | PRT | Artificial | Luk326 | LPAPKNLVVSRVTEDSARLSWTAPDAAFDSF WIAYYERTQQGEAIELLVPGSERSYDLTGLKP GTEYWVGIDGVKGGEVSQPLKAHFTT |
| 312 | PRT | Artificial | Luk327 | LPAPKNLVVSRVTEDSARLSWTAPDAAFDSF AIFYLEWLYHGEAIKLYVPGSERSYDLTGLKP GTEYYVVIHGVKGGFVSTPLFATFTT |
| 313 | PRT | Artificial | Luk329 | LPAPKNLVVSRVTEDSARLSWTAPDAAFDSF WIGYWEGIGYGEAITLLVPGSERSYDLTGLKP GTEYNVGIDGVKGGDFSTPLWARFTT |
| 314 | PRT | Artificial | Luk330 | LPAPKNLVVSRVTEDSARLSWTAPDAAFDSF WIGYHEFSTYGEAIDLLVPGSERSYDLTGLKP GTEYTVKIAGVKGGATSVPLVATFTT |
| 315 | PRT | Artificial | Luk331 | LPAPKNLVVSRVTEDSARLSWTAPDAAFDSF AIFYFEDDERGEAIVLNVPGSERSYDLTGLKP GTEYHVIIHGVKGGQISSPLYATFTT |
| 316 | PRT | Artificial | Luk332 | LPAPKNLVVSRVTEDSARLSWTAPDAAFDSF WIAYGEWEYPGEAIELLVPGSERSYDLTGLKP GTEYHVGIDGVKGGRVSYPLRAQFTT |

TABLE 6-continued

Nucleic Acid and Amino Acid Sequences of the Disclosure

| SEQ ID NO: | Type | Species | Description | Sequence |
|---|---|---|---|---|
| 317 | PRT | Artificial | Luk333 | LPAPKNLVVSRVTEDSARLSWTAPDAAFDSF RIHYWEGLFVGEAIVLSVPGSERSYDLTGLKP GTEYAVPIYGVKGGSISKPLYALFTT |
| 318 | PRT | Artificial | Luk334 | LPAPKNLVVSRVTEDSARLSWTAPDAAFDSF HIGYHEAEGFGEAIALLVPGSERSYDLTGLKP GTEYPVGISGVKGGFVSFPLWARFTT |
| 319 | PRT | Artificial | Luk335 | LPAPKNLVVSRVTEDSARLSWTAPDAAFDSF WIGYNEIVNHGEAIDLVVPGSERSYDLTGLKP GTEYRVSIGGVKGGHWSVPLWARFTT |
| 320 | PRT | Artificial | Luk336 | LPAPKNLVVSRVTEDSARLSWTAPDAAFDSF WIGYHEWIGPGEAISLLVPGSERSYDLTGLKP GTEYWVGIAGVKGGWSSRPLSATFTT |
| 321 | PRT | Artificial | Luk337 | LPAPKNLVVSRVTEDSARLSWTAPDAAFDSF WIGYEEPLYFGEAIDLVVPGSERSYDLTGLKP GTEYRVHIGGVKGGRVSIPLEAEFTT |
| 322 | PRT | Artificial | Luk338 | LPAPKNLVVSRVTEDSARLSWTAPDAAFDSF WIAYEEDNAQGEAIELLVPGSERSYDLTGLKP GTEYDVKIDGVKGGRVSTPLVARFTT |
| 323 | PRT | Artificial | Luk339 | LPAPKNLVVSRVTEDSARLSWTAPDAAFDSF VIFYWEGQWNGEAILLDVPGSERSYDLTGLK PGTEYIVPIHGVKGGWISLPLVATFTT |
| 324 | PRT | Artificial | Luk340 | LPAPKNLVVSRVTEDSARLSWTAPDAAFDSF WIGYHESPYAGEAIDLVVPGSERSYDLTGLKP GTEYAVGIAGVKGGYSIPLRAIFTT |
| 325 | PRT | Artificial | Luk342 | LPAPKNLVVSRVTEDSARLSWTAPDAAFDSF WIGYSEPTIYGEAIDLLVPGSERSYDLTGLKP GTEYFVGITGVKGGWNSRPLSAIFTT |
| 326 | PRT | Artificial | Luk343 | LPAPKNLVVSRVTEDSARLSWTAPDAAFDSF AIFYTETHWFGEAINLPVPGSERSYDLTGLKP GTEYGVIIHGVKGGYISDPLWAAFTT |
| 327 | PRT | Artificial | Luk344 | LPAPKNLVVSRVTEDSARLSWTAPDAAFDSF WISYVEPVFSGEAIELLVPGSERSYDLTGLKP GTEYIVGIGGVKGGGWSIPLEAHFTT |
| 328 | PRT | Artificial | Luk345 | LPAPKNLVVSRVTEDSARLSWTAPDAAFDSF SIFYIEAKFRGEAIRLGVPGSERSYDLTGLKPG TEYFVWIHGVKGGEISDPLEAPFTT |
| 329 | PRT | Artificial | Luk346 | LPAPKNLVVSRVTEDSARLSWTAPDAAFDSF WIAYYEIVGWGEAITLLVPGSERSYDLTGLKP GTKYVVLIDGVKGGLLSQPLHAEFAT |
| 330 | PRT | Artificial | Luk347 | LPAPKNLVVSRVTEDSARLSWTAPDAAFDSF WIGYHETTRFGEAIDLLVPGSERSYDLTGLKP GTEYVVAIQGVKGGHVSQPLRAPFTT |
| 331 | PRT | Artificial | Luk348 | LPAPKNLVVSRVTEDSARLSWTAPDAAFDSF SIIYLEASFRGEAIVLTVPGSERSYDLTGLKPG TEYFVSIYGVKGGHFSPPLDAIFTT |
| 332 | PRT | Artificial | Luk349 | LPAPKNLVVSRVTEDSARLSWTAPDAAFDSF WIGYREWIQWGEAISLLVPGSERSYDLTGLKP GTEYRVGITGVNGGVTSVPLHAKFTT |
| 333 | PRT | Artificial | Luk350 | LPAPKNLVVSRVTEDSARLSWTAPDAAFDSF WIAYHEGLSWGEAIDLLVPGSERSYDLTGLK PGTEYTVSIDGVKGGYTSEPLRASFTT |
| 334 | PRT | Artificial | Luk351 | LPAPKNLVVSRVTEDSARLSWTAPDAAFDSF WIGYDETLTYGEAITLLVPGSERSYDLTGLKP GTEYTVGIDGVKGGRNSVPLKATFTT |

TABLE 6-continued

Nucleic Acid and Amino Acid Sequences of the Disclosure

| SEQ ID NO: | Type | Species | Description | Sequence |
|---|---|---|---|---|
| 335 | PRT | Artificial | Luk353 | LPAPKNLVVSRVTEDSARLSWTAPDAAFDSF WIGYHEPRAWGEAIDLLVPGSERSYDLTGLK PGTEYLVGIGGVKGGKQSKPLVAKFTT |
| 336 | PRT | Artificial | Luk354 | LPAPKNLVVSRVTEDSARLSWTAPDAAFDSF WIGYTEQKNHGEAIDLLVPGSERSYDLTGLK PGTEYEVNIAGVKGGGWSIPLNAWFTT |
| 337 | PRT | Artificial | Luk355 | LPAPKNLVVSRVTEDSARLSWTAPDAAFDSF KIVYVEIHYRGEAIHLSVPGSERSYDLTGLKP GTEYHVVIHGVKGGGISLPLDAPFTT |
| 338 | PRT | Artificial | Luk356 | LPAPKNLVVSRVTEDSARLSWTAPDATFDSF WIGYSEDQRTGEAIDLVPGSERSYDLTGLKP GTEYRVAIAGVKGGYISQPLSANFTT |
| 339 | PRT | Artificial | Luk357 | LPAPKNLVVSRVTEDSARLSWTAPDAAFDSF TIHYFESLLTGEAISLVVPGSERSYDLTGLKPG TEYLVPIYGVKGGFISQPLIAIFTT |
| 340 | PRT | Artificial | Luk358 | LPAPKNLVVSRVTEDSARLSWTAPDAAFDSF AINYYEYYPAGEAIVLTVPGSERSYDLTGLKP GTEYFVAIYGVKGGYISPPLSAIFTT |
| 341 | PRT | Artificial | Luk361 | LPAPKNLVVSRVTEDSARLSWTAPDAAFDSF SIYYYEYYANGEAIVLTVPGSERSYDLTGLKP GTEYFVAIYGVKGGYVSDPLSAIFTT |
| 342 | PRT | Artificial | Luk362 | LPAPKNLVVSRVTEDSARLSWTAPDAAFDSF PIYYLEYSFTGEAIVLTVPGSERSYDLTGLKPG TEYAVYIYGVKGGWISDPLSAIFTT |
| 343 | PRT | Artificial | Luk363 | LPAPKNLVVSRVTEDSARLSWTAPDAAFDSF RIYYYEWASYGEAIVLTVPGSERSYDLTGLKP GTEYFVGIYGVKGGHISRPLSAIFTT |
| 344 | PRT | Artificial | Luk364 | LPAPKNLVVSRVTEDSARLSWTAPDAAFDSF RIFYHEYSYRGEAIVLTVPGSERSYDLTGLKP GTEYLVIIHSVKGGSVSSPLSAIFTT |
| 345 | PRT | Artificial | Luk365 | LPAPKNLVVSRVTEDSARLSWTAPDAAFDSF TIYYYEYWYGGEAIVLTVPGSERSYDLTGLK PGTEYWVGIYGVKGGYISSPLSAIFTT |
| 346 | PRT | Artificial | Luk366 | LPAPKNLVVSRVTEDSARLSWTAPDAAFDSF AIFYYEFNWGGEAIVLTVPGSERSYDLTGLKP GTEYWVGIYGVKGGYISYPLSAIFTT |
| 347 | PRT | Artificial | Luk368 | LPAPKNLVVSRVTEDSARLSWTAPDAAFDSF AIYYFESINLGDAIVLTVPGSERSYDLTGLKPG TEYVVYIYGVKGGYISYPLSAIFTT |
| 348 | PRT | Artificial | Luk369 | LPAPKNLVVSRVTEDSARLSWTAPDAAFDSF RIFYYEYGGGGEAIVLTVPGSERSYDLTGLKP GTEYHVGIYGVKGGYISPPLSAIFTT |
| 349 | PRT | Artificial | Luk370 | LPAPKNLVVSRVTEDSARLSWTAPDAAFDSF SIYYFEYWTYGEAIVLTVPGSERSYDLTGLKP GTEYYVYIYGVKGGYISDPLSAIFTT |
| 350 | PRT | Artificial | Luk371 | LPAPKNLVVSRVIEDSARLSWTAPDAAFDSFT IFYYEYDSGEAIVLTVPGSERSYDLTGLKPGT EYTVAIFGVKGGYISAPLSAIFTT |
| 351 | PRT | Artificial | Luk372 | LPAPKNLVVSRVTEDSARLSWTAPDAAFDSF LIGYEEYANAGEAIVLTVPGSERSYDLTGLKP GTEYLVFIYGVKGGYYSYPLSAIFTT |
| 352 | PRT | Artificial | Luk373 | LPAPKNLVVSRVTEDSARLSWTAPDAAFDSF HIYYFEYINLGEAIVLTVPGSERSYDLTGLKPG TEYFVYIHGVKGGFVSDPLSAIFTT |

TABLE 6-continued

Nucleic Acid and Amino Acid Sequences of the Disclosure

| SEQ ID NO: | Type | Species | Description | Sequence |
|---|---|---|---|---|
| 353 | PRT | Artificial | Luk374 | LPAPKNLVVSRVTEDSARLSWTAPDAAFDSF VIEYWEYRLAGEAIVLTVPGSERSYDLTGLKP GTEYFVGIYGVKGGAVSLPLSAIFTT |
| 354 | PRT | Artificial | Luk375 | LPAPKNLVVSRVTEDSARLSWTAPDAAFDSF HIDYWEYVFLGEAIVLTVPGSERSYDLTGLKP GTEYFVSITGVKGGRYSYPLSAIFTT |
| 355 | PRT | Artificial | Luk376 | LPAPKNLVVSRVTEDSARLSWTAPDAAFDSF TIPYYEYWWSGEAIVLTVPGSERSYDLTGLKP GTEYWVGIYGVKGGYISSPLSAIFTT |
| 356 | PRT | Artificial | Luk377 | LPAPKNLVVSRVTEDSARLSWTAPDAAFDSF WINYWEYYPHGEAIVLTVPGSERSYDLTGLK PGTEYFVGIYGVKGGSYSHPLSAIFTT |
| 357 | PRT | Artificial | Luk378 | LPAPKNLVVSRVTEDSARLSWTAPDAAFDSF AIFYHEDAYTGEAIVLTVPGSERSYDLTGLKP GTEYFVVIHGVKGGFLSRPLSAIFTT |
| 358 | PRT | Artificial | Luk379 | LPAPKNLVVSRVTEDSARLSWTAPDAAFDSF YILYHEYEYSGEAIVLTVPGSERSYDLTGLKP GTEYFVAIYGVKGGLYSAPLSAIFTT |
| 359 | PRT | Artificial | Luk380 | LPAPKNLVVSRVNEDSARLSWTAPDAAFDSF DIVYGVGEAIVLTVPGSERSYDLTGLKPGTEY YVPIAGVKGGGVSWPLSAIFTT |
| 360 | PRT | Artificial | Luk381 | LPAPKNLVVSRVTEDSARLSWTAPDAAFDSF RIYYYEYYKYGEAIVLTVPGSERSYDLTGLKP GTEYFVAIYGVKGGEISDPLSAIFTT |
| 361 | PRT | Artificial | Luk382 | LPAPKNLVVSRVTEDSARLSWTAPDAAFDSF GIIYDETAQYGEAIVLTVPGSERSYDLTGLKP GTEYLVPIHGVKGGTISYPLSAIFTT |
| 362 | PRT | Artificial | Luk390 | LPAPKNLVVSRVTEDSARLSWTYIHHGFDSFL IQYQESEKVGEAIVLTVPGSERSYDLTGLKPG TEYTVSIYGVVWGYWNPTQYSNPLSAIFTT |
| 363 | PRT | Artificial | Luk394 | LPAPKNLVVSRVTEDSARLSWDQYRLNFDSF LIQYQESEKVGEAIVLTVPGSERSYDLTGLKP GTEYTVSIYGVNWGYFLAPEISNPLSAIFTT |
| 364 | PRT | Artificial | Luk399 | LPAPKNLVVSRVTEDSARLSWPGQTRKFNIFD SFLIQYQESEKVGEAIVLTVPGSERSYDLTGL KPGTEYTVSIYGVVGIFLTFGSNPLSAIFTT |
| 365 | PRT | Artificial | Luk409 | LPAPKNLVVSRVTEDSARLSWKYTLYQHYFD SFLIQYQESEKVGEAIVLTVPGSERSYDLTGL KPGTEYTVSIYGVLAWWSFGSNPLSAIFTT |
| 366 | PRT | Artificial | Luk412 | LPAPKNLVVSRVTEDSARLSWTAPDAAFDSF GIGYLEYPWYGEAIVLTVPGSERSYDLTGLKP GTEYFVDIYGVKGGWWSYPLSAIFTT |
| 367 | PRT | Artificial | Luk414 | LPAPNLLVVSRVTEDSARLSWTAPDAAFDSF WIDYIETYYYGEAIVLTVPGSERSYDLTGLKP GTEYLVDIYGVKGGWYSLPLSAIFTT |
| 368 | PRT | Artificial | Luk415 | LPAPKNLVVSRVTEDSARLSWTAPDAAFDSF EISYTEYGISGEAIVLTVPGSERSYDLTGLKPG TEYFVDIYGVKGGYLSYPLSAIFTT |
| 369 | PRT | Artificial | Luk417 | LPAPKNLVVSRVTEDSARLSWTAPDAAFDSF NIDYFEYYEFGEAIVLTVPGSERSYDLTGLKP GTEYFVDIYGVKGGSWSLPLSAIFTT |
| 370 | PRT | Artificial | Luk420 | LPAPKNLVVSRVTEDSARLSWWLGRFNFDSF LIQYQESEKVGEAIVLTVPGSERSYDLTGLKP GTEYTVSIYGVKQWIISEESLSNPLSAIFTT |

TABLE 6-continued

Nucleic Acid and Amino Acid Sequences of the Disclosure

| SEQ ID NO: | Type | Species | Description | Sequence |
|---|---|---|---|---|
| 371 | PRT | Artificial | Luk428 | LPAPKNLVVSRVTEDSARLSWGIKEETIIFDSFLIQYQESEKVGEAIVLTVPGSERSYDLTGLKPGTEYTVSIYGVNIIELHLWSNPLSAIFTT |
| 372 | PRT | Artificial | Luk438 | LPAPKNLVVSRVTEDSARLSWWRKPKRWRHFDSFLIQYQESEKVGEAIVLTVPGSERSYDLTGLKPGTEYTVSIYGVAPDTPTPVIISNPLSAIFTT |
| 373 | PRT | Artificial | Luk445 | LPAPKNLVVSRVTEDSARLSWEVNTKTSNKFDSFLIQYQESEKVGEAIVLTVPGSERSYDLTGLKPGTEYTVSIYGVGYWLTNVVLASNPLSAIFTT |
| 374 | PRT | Artificial | Luk447 | LPAPKNLVVSRVTEDSARLSWGIDDYFVHFFDSFLIQYQESEKVGEAIVLTVPGSERSYDLTGLKPGTEYTVSIYGVSIHFEFTTYSRSNPLSAIFTT |
| 375 | PRT | Artificial | Luk449 | LPAPKNLVVSRVTEDSARLSWTAPDAAFDSFDISYDEYPEFGEAIVLTVPGSERSYDLTGLKPGTEYLVDIIGVKGGEISLPLSAIFTT |
| 376 | PRT | Artificial | Luk452 | LPAPKNLVVSRVTEDSARLSWTAPDAAFDSFNIHYAEYPDFGEAIVLTVPGSERSYDLTGLKPGTEYIVDIWGVKGGLGSWPLSAIFTT |
| 377 | PRT | Artificial | Luk460 | LPAPKNLVVSRVTEDSARLSWIWGGESFDSFLIQYQESEKVGEAIVLTVPGSERSYDLTGLKPGTEYTVSIYGVGQIGFIYRPEGSNPLSAIFTT |
| 378 | PRT | Artificial | Luk461 | LPAPKNLVVSRVTEDSARLSWLGPTATVFDSFLIQYQESEKVGEAIVLTVPGSERSYDLTGLKPGTEYTVSIYGVWSLLHHRFSNPLSAIFTT |
| 379 | PRT | Artificial | Luk462 | LPAPKNLVVSRVTEDSARLSWHPIWVDFDSFLIQYQESEKVGEAIVLTVPGSERSYDLTGLKPGTEYTVSIYGVRGDGFEVILHSNPLSAIFTT |
| 380 | PRT | Artificial | Luk463 | LPAPKNLVVSRVTEDSARLSWKWFKTTAFDSFLIQYQESEKVGEAIVLTVPGSERSYDLTGLKPGTEYTVSIYGVLHASEIHQWESSNPLSAIFTT |
| 381 | PRT | Artificial | Luk464 | LPAPKNLVVSRVTEDSARLSWWWPVAPFDSFLIQYQESEKVGEAIVLTVPGSERSYDLTGLKPGTEYTVSIYGVGAINYVYFPTWSNPLSAIFTT |
| 382 | PRT | Artificial | Luk465 | LPAPKNLVVSRVTEDSARLSWVTDPGTNFDSFLIQYQESEKVGEAIVLTVPGSERSYDLTGLKPGTEYTVSIYGVWSWVHSRYSNPLSAIFTT |
| 383 | PRT | Artificial | Luk467 | LPAPKNLVVSRVTEDSARLSWPWLQYPFFDSFLIQYQESEKVGEAIVLTVPGSERSYDLTGLKPGTEYTVSIYGVGYLDWHIFQLASNPLSAIFTT |
| 384 | PRT | Artificial | Luk468 | LPAPKNLVVSRVTEDSARLSWQPSHGEFANFDSFLIQYQESEKVGEAIVLTVPGSERSYDLTGLKPGTEYTVSIYGVQPWYRGGHIYDFSNPLSAIFTT |
| 385 | PRT | Artificial | Luk470 | LPAPKNLVVSRVTEDSARLSWINYSDPDFFDSFLIQYQESEKVGEAIVLTVPGSERSYDLTGLKPGTEYTVSIYGVYHWWYRGTPVVSNPLSAIFTT |
| 386 | PRT | Artificial | Luk473 | LPAPKNLVVSRVTEDSARLSWLEGFFPQPLFDSFLIQYLESEKVGEAIVLTVPGSERSYDLTGLKPGTEYTVSIYGVPWYHHRWWFASNPLSAIFTT |

TABLE 6-continued

Nucleic Acid and Amino Acid Sequences of the Disclosure

| SEQ ID NO: | Type | Species | Description | Sequence |
|---|---|---|---|---|
| 387 | PRT | Artificial | Luk475 | LPAPKNLVVSRVTEDSARLSWKQHTNTHYQF DSFLIQYQESEKVGEAIVLTVPVSERSYDLTG LKPGTEYTVSIYGVRWIDNHLKFNVHSNPLS AIFTT |
| 388 | PRT | Artificial | Luk476 | LPAPKNLVVSRVTEDSARLSWLEGFFPQPLFD SFLIQYQESEKVGEAIVLTVPGSERSYDLTGL KPGTEYTVSIYGVPWYHHRWWFASNPLSAIF TT |
| 389 | PRT | Artificial | Luk478 | LPAPKNLVVSRVTEDSARLSWLEGFFPQPLFD SFLIQYQESEKVGEAIVLTVPGSERSYDLTGL KPGTEYTVSIYGVASRWHSFPVTTSNPLSAIFT T |
| 390 | PRT | Artificial | Luk479 | LPAPKNLVVSRVTEDSARLSWLEGFFPQPLFD SFLIQYQESEKVGEAIVLTVPGSERSYGLTGL KPGTEYTVSIYGVPWYHHRWWFASNPLSAIF TT |
| 391 | PRT | Artificial | Luk483 | LPAPKNLVVSRVTEDSARLSWTAPDAAFDSF RIFYYERFTWGEAIVLTVPGSERSYDLTGLKP GTEYPVHIWGVKGGIDSRPLSAIFTT |
| 392 | PRT | Artificial | Luk486 | LPAPKNLVVSRVTEDSARLSWTAPDAAFDSF AIRYGEETVHGEAIALIVPGSERSYDLTGLKP GTEYPVAIAGVKGGTWSIPLSAIFTT |
| 393 | PRT | Artificial | Luk487 | LPAPKNLVVSRVTEDSARLSWTAPDAAFDSF AIHYLEFHYAGEAIVLTVPGSERSYDLTGLKP GTEYWVVIYGVKGDLISGPLSAIFTT |
| 394 | PRT | Artificial | Luk498 | LPAPKNLVVSRVTEDSARLSWLPGPFRRFDSF LIQYQESEKVGEAIVLTVPGSERSYDLTGLKP GTEYTVSIYGVVNHEWYHAFSNPLSAIFTT |
| 395 | PRT | Artificial | Luk499 | LPAPKNLVVSRVTEDSARLSWIGRELIWFDSF LIQYQESEKVGEAIVLTVPGSERSYDLTGLKP GTEYTVSIYGVVTHEWRSEFSNPLSAIFTT |
| 396 | PRT | Artificial | Luk500 | LPAPKNLVVSRVTEDSARLSWKKPSYYIFDSF LIQYQESEKVGEAIVLTVPGSERSYDLTGLKP GTEYTVSIYGVVNHEWYHAFSNPLSAIFTT |
| 397 | PRT | Artificial | Luk505 | LPAPKNLVVSRVTEDSARLSWQQAARWFDSF LIQYQESEKVGEAIVLTVPGSERSYDLTGLKP GTEYTVSIYGVVTREWFHSFSNPLSAIFTT |
| 398 | PRT | Artificial | Luk507 | LPAPKNLVVSRVTEDSARLSWQHHGFRLFDS FLIQYQESEKVGEAIVLTVPGSERSYDLTGLK PGTEYTVSIYGVFTHEWFHEFSNPLSAIFTT |
| 399 | PRT | Artificial | Luk510 | LPAPKNLVVSRVTEDSARLSWDEYSVTTWW FDSFLIQYQESEKVGEAIVLTVPGSERSYDLT GLKPGTEYTVSIYGVNELYRPWVASNPLSAIF TT |
| 400 | PRT | Artificial | Luk513 | LPAPKNLVVSRVTEDSARLSWWTGGWRRNP FDSFLIQYQESEKVGEAIVLTVPGSERSYDLT GLKPGTEYTVSIYGVQLHRTIIAGESNPLSAIF TT |
| 401 | PRT | Artificial | Luk516 | LPAPKNLVVSRVTEDSARLSWVGANSRHWF DSFLIQYQESEKVGEAIVLTVPGSERSYDLTG LKPGTEYTVSIYGVAVSEWFHSFSNPLSAIFTT |
| 402 | PRT | Artificial | Luk517 | LPAPKNLVVSRVTEDSARLSWVNHLEGEAW FDSFLIQYQESEKVGEAIVLTVPGSERSYDLT GLKPGTEYTVSIYGVQTHEWWHKFSNPLSAI FTT |

TABLE 6-continued

Nucleic Acid and Amino Acid Sequences of the Disclosure

| SEQ ID NO: | Type | Species | Description | Sequence |
|---|---|---|---|---|
| 403 | PRT | Artificial | Luk519 | LPAPKNLVVSRVTEDSARLSWDLEHHNYHYF DSFLIQYQESEKVGEAIVLTVPGSERSYDLTG LKPGTEYTVSIYGVWFLQPAIHPPSNPLSAIFT T |
| 404 | PRT | Artificial | Luk520 | LPAPKNLVVSRVTEDSARLSWTAPDAAFDSF AIFYYEYWSNGEAIVLTVPGSERSYDLTGLKP GTEYWVGIHGVKGGLISHPLSAIFTT |
| 405 | PRT | Artificial | Luk521 | LPAPKNLVVSRVTEDSARLSWTAPDAAFDSFI ITYEEATLNGEAIVLTVPGSERSYDLTGLKPG TEYTVGITGVKGGLGSYPLSAIFTT |
| 406 | PRT | Artificial | Luk522 | LPAPKNLVVSRVTEDSARLSWTAPDAAFDSF TIFYLEQRFQGEAIVLTVPGSERSYDLTGLKP GTEYAVIIHGVKGGWISFPLSAIFTT |
| 407 | PRT | Artificial | Luk523 | LPAPKNLVVSRVTEDSARLSWTAPDAAFDSF NIPYLERQLYGEAIVLTVPGSERSYDLTGLKP GTEYTVTIGGVKGGAPSRPLSAIFTT |
| 408 | PRT | Artificial | Luk524 | LPAPKNLVVSRVTEDSARLSWTAPDAAFDSF FIFYLEYAHPGEAIVLTVPGSERSYDLTGLKP GTEYHVIIHGVKGGLISEPLSAIFTT |
| 409 | PRT | Artificial | Luk525 | LPAPKNLVVSRVTEDSARLSWTAPDAAFDSF YIFYWESVTGGEAIVLTVPGSERSYDLTGLKP GTEYIVIIHGVKGGLISDPLSAIFTT |
| 410 | PRT | Artificial | Luk526 | LPAPKNLVVSRVTEDSARLSWTAPDAAFDSF PIFYDEHHQWGEAIVLTVPGSERSYDLTGLKP GTEYWVAIYGVKGGYYSSPLSAIFTT |
| 411 | PRT | Artificial | Luk527 | LPAPKNLVVSRVTEDSARLSWTAPDAAFDSF HIFYWEPNEVGEAIVLTVPGSERSYDLTGLKP GTEYFVEIYGVKGGEISYPLSAIFTT |
| 412 | PRT | Artificial | Luk528 | LPAPKNLVVSRVTEDSARLSWTAPDAAFDSF TIDYREETPKGEAIVLTVPGSERSYDLTGLKP GTEYWVIILGVKGGGDSFPLSAIFTT |
| 413 | PRT | Artificial | Luk529 | LPAPKNLVVSRVTEDSARLSWTAPDAAFDSF GIYYGEWNPKGEAIVLTVPGSERSYDLTGLKP GTEYWVIISGVKGGPQSIPLSAIFTT |
| 414 | PRT | Artificial | Luk530 | LPAPKNLVVSRVTEDSARLSWTAPDAAFDSF GIFYHEIEENGEAIVLTVPGSERSYDLTGLKPG TEYFVAIHGVKGGVISTPLSAIFTT |
| 415 | PRT | Artificial | Luk531 | LPAPKNLVVSRVTEDSARLSWTAPDAAFDSF RIFYYELYHAGEAIVLTVPGSERSYDLTGLKP GTEYFVIIHGVKGGQISLPLSAIFTT |
| 416 | PRT | Artificial | Luk532 | LPAPKNLVVSRVTEDSARLSWTAPDAAFDSF TIFYLELESSGEAIVLTVPGSERSYDLTGLKPG TEYNVIIHGVKGGFISSPLSAIFTT |
| 417 | PRT | Artificial | Luk533 | LPAPKNLVVSRVTEDSARLSWTAPDAAFDSF PIFYVELRNPGEAIVLTVPGSERSYDLTGLKPG TEYHVVIHGVKGGFISHPLSAIFTT |
| 418 | PRT | Artificial | Luk534 | LPAPKNLVVSRVTEDSARLSWTAPDAAFDSF TIFYTEWNEFGEAIVLTVPGSERSYDLTGLKP GTEYFVIIHGVKGGQISVPLSAIFTT |
| 419 | PRT | Artificial | Luk535 | LPAPKNLVVSRVTEDSARLSWTAPDAAFDSF VIFYLEPTTQGEAIVLTVPGSERSYDLTGLKPG TEYFVIIHGVKGGPVSGPLSAIFTT |
| 420 | PRT | Artificial | Luk536 | LPAPKNLVVSRVTEDSARLSWTAPDAAFDSF WIAYIETDGWGEAIVLTVPGSERSYDLTGLKP GTEYFVPIHGVKGGYISQPLSAIFTT |

TABLE 6-continued

Nucleic Acid and Amino Acid Sequences of the Disclosure

| SEQ ID NO: | Type | Species | Description | Sequence |
|---|---|---|---|---|
| 421 | PRT | Artificial | Luk537 | LPAPKNLVVSRVTEDSARLSWTAPDAAFDSF AIFYHEHKIRGEAIVLTVPGSERSYDLTGLKP GTEYLVIIHGVKGGYISLPLSAIFTT |
| 422 | PRT | Artificial | Luk538 | LPAPKNLVVSRVTEDSARLSWTAPDAAFDSF PIFYLERANRGEAIVLTVPGSERSYDLTGLKP GTEYFVIIHGVKGGTISDPLSAIFTT |
| 423 | PRT | Artificial | Luk539 | LPAPKNLVVSRVTEDSARLSWTAPDAAFDSF AIFYLETLYHGEAIVLTVPGSERSYDLTGLKP GTEYLVVIHGVKGGIISSPLSAIFTT |
| 424 | PRT | Artificial | Luk540 | LPAPKNLVVSRVTEDSARLSWTAPDAAFDSF HIEYPEDTEQGEAIVLTVPGSERSYDLTGLKP GTEYNVHITGVKGGSKSAPLSAIFTT |
| 425 | PRT | Artificial | Luk541 | LPAPKNLVVSRVTEDSARLSWTAPDAAFDSF NILYTETEQSGEAIVLTVPGSERSYDLTGLKP GTEYIVIIHGVKGGFISGPLSAIFTT |
| 426 | PRT | Artificial | Luk542 | LPAPKNLVVSRVTEDSARLSWTAPDAAFDSF TIFYPEFRGDGEAIVLTVPGSERSYDLTGLKPG TEYGVIIHGVKGGDSNPLSAIFTT |
| 427 | PRT | Artificial | Luk543 | LPAPKNLVVSRVTEDSARLSWTAPDAAFDSF AIFYTETFHYGEAIVLTVPGSERSYDLTGLKP GTEYLVVIHGVKGGDISAPLSAIFTT |
| 428 | PRT | Artificial | Luk544 | LPAPKNLVVSRVTEDSARLSWTAPDAAFDSF TIHYLEEFWLGEAIVLTVPGSERSYDLTGLKP GTEYFVAIYGVKGGFISVPLSAIFTT |
| 429 | PRT | Artificial | Luk545 | LPAPKNLVVSRVTEDSARLSWTAPDAAFDSF VIAYIEERWSGEAIVLTVPGSERSYDLTGLKP GTEYFVLIHGVKGGFISNPLSAIFTT |
| 430 | PRT | Artificial | Luk546 | LPAPKNLVVSRVTEDSARLSWTAPDAAFDSF SIYYGEWPHGGEAIVLTVPGSERSYDLTSLKP GTEYFVLIIGVKGGQLSHPLSAIFTT |
| 431 | PRT | Artificial | Luk547 | LPAPKNLVVSRVTEDSARLSWTAPDAAFDSF TIFYLESSGTGEAIVLTVPGSERSYDLTGLKPG TEYLVIIHGVKGGRISNPLSAIFTT |
| 432 | PRT | Artificial | Luk548 | LPAPKNLVVSRVTEDSARLSWTAPDAAFDSF AIYYGEWHPDGEAIVLTVPGSERSYDLTGLKP GTEYWVFILGVKGGQNSQPLSAIFTT |
| 433 | PRT | Artificial | Luk549 | LPAPKNLVVSRVTEDSARLSWTAPDAAFDSF TIFYAESGNWGEAIVLTVPGSERSYDLTGLKP GTEYFVPIWGVKGGHESHPLSAIFTT |
| 434 | PRT | Artificial | Luk550 | LPAPKNLVVSRVTEDSARLSWTAPDAAFDSF AIFYAETDTKGEAIVLTVPGSERSYDLTGLKP GTEYLVIIHGVKGGSISVPLSAIFTT |
| 435 | PRT | Artificial | Luk551 | LPAPKNLVVSRVTEDSARLSWTAPDAAFDSF RIFYQEYSNHGEAIVLTVPGSERSYDLTGLKP GTEYFVPIYGVKGGFISRPLSAIFTT |
| 436 | PRT | Artificial | Luk552 | LPAPKNLVVSRVTEDSARLSWTAPDAAFDSF QIFYDENLWLGEAIVLTVPGSERSYDLTGLKP GTEYFVAIHGVKGGFISQPLSAIFTT |
| 437 | PRT | Artificial | Luk553 | LPAPKNLVVSRVTEDSARLSWTAPDAAFDSF HIFYAEHEKWGEAIVLTVPGSERSYDLTGLKP GTEYWVAIHGVKGGHISRPLSAIFTT |
| 438 | PRT | Artificial | Luk554 | LPAPKNLVVSRVTEDSARLSWTAPDAAFDSF SIFYLETFRRGEAIVLTVPGSERSYDLTGLKPG TEYLVIIHGVKGGYVSDPLSAIFTT |

TABLE 6-continued

Nucleic Acid and Amino Acid Sequences of the Disclosure

| SEQ ID NO: | Type | Species | Description | Sequence |
|---|---|---|---|---|
| 439 | PRT | Artificial | Luk555 | LPAPKNLVVSRVTEDSARLSWTAPDAAFDSF SIFYPETNYQGEAIVLTVPGSERSYDLTGLKP GTEYLVVIHGVKGGYISDPLSAIFTT |
| 440 | PRT | Artificial | Luk556 | LPAPKNLVVSRVTEDSARLSWTAPDAAFDSF AIFYIEEETNGEAIVLTVPGSERSYDLTGLKPG TEYQVIIHGVKGGFISLPLSAIFTT |
| 441 | PRT | Artificial | Luk557 | LPAPKNLVVSRVTEDSARLSWTAPDAAFDSF VIFYPEVNFRGEAIVLTVPGSERSYDLTGLKP GTEYLVIIHGVKGGYISTPLSAIFTT |
| 442 | PRT | Artificial | Luk558 | LPAPKNLVVSRVTEDSARLSWTAPDAAFDSF AIFYHEWWKSGEAIVLTVPGSERSYDLTGLK PGTEYHVVIHGVKGGHISTPLSAIFTT |
| 443 | PRT | Artificial | Luk559 | LPAPKNLVVSRVTEDSARLSWTAPDAAFDSF TIHYPETRPTGEAIVLTVPGSERSYDLTGLKPG TEYFVVIYGVKGGWISPPLSAIFTT |
| 444 | PRT | Artificial | Luk560 | LPAPKNLVVSRVTEDSARLSWTAPDAAFDSF HIFYIEHVQVGEAIVLTVPGSERSYDLTGLKP GTEYFVIIHGVKGGIISPPLSAIFTT |
| 445 | PRT | Artificial | Luk561 | LPAPKNLVVSRVTEDSARLSWTAPDAAFDSF TIFYYPELYFHGEAIVLTVPGSERSYDLTGLKP GTEYLVVIHGVKGGFISPPLSAIFTT |
| 446 | PRT | Artificial | Luk562 | LPAPKNLVVSRVTEDSARLSWTAPDAAFDSF AIFYKEYTHGGEAIVLTVPGSERSYDLTGLKP GTEYWVIIHSVKGGSISYPLSAIFTT |
| 447 | PRT | Artificial | Luk563 | LPAPKNLVVSRVTEDSARLSWTAPDAAFDSF QIFYPEHYQDGEAIVLTVPGSERSYDLTGLKP GTEYLVVIHGVKGGWISSPLSAIFTT |
| 448 | PRT | Artificial | Luk564 | LPAPKNLVVSRVTEDSARLSWTAPDAAFDSF TIFYIEFRYPGEAIVLTVPGSERSYDLTGLKPG TEYFVAIHGVKGGYISDPLSAIFTT |
| 449 | PRT | Artificial | Luk565 | LPAPKNLVVSRVTEDSARLSWTAPDAAFDSF HIFYLETWGSGEAIVLTVPGSERSYDLTGLKP GTEYFVVIHGVKGGLISSPLSAIFTT |
| 450 | PRT | Artificial | Luk566 | LPAPKNLVVSRVTEDSARLSWTAPDAAFDSF AIFYYEHADAGEAIVLTVPGSERSYDLTGLKP GTEYFVIIHGVKGGYISKPLSAIFTT |
| 451 | PRT | Artificial | Luk567 | LPAPKNLVVSRVTEDSARLSWTAPDAAFDSF AIFYQEDSDHGEAIVLTVPGSERSYDLTGLKP GTEYFVAIHGVKGGTISKPLSAIFTT |
| 452 | PRT | Artificial | Luk568 | LPAPKNLVVSRVTEDSARLSWTAPDAAFDSF RIFYIEEHDVGEAIVLTVPGSERSYDLTGLKPG TEYIVIIHGVKGGYISDPLSAIFTT |
| 453 | PRT | Artificial | Luk569 | LPAPKNLVVSRVTEDSARLSWTAPDAAFDSF TILYPETQTIGEAIVLTVPGSERSYDLTGLKPG TEYFVGIHGVKGGIISDPLSAIFTT |
| 454 | PRT | Artificial | Luk570 | LPAPKNLVVSRVTEDSARLSWTAPDAAFDSFI IYYGEWREHGEAIVLTVPGSERSYDLTGLKPG TEYFVLIQGVKGGQTSGPLSAIFTT |
| 455 | PRT | Artificial | Luk571 | LPAPKNLVVSRVTEDSARLSWTAPDAAFDSF KIFYLEPKENGEAIVLTVPGSERSYDLTGLKP GTEYFVIITGVKGGFISEPLSAIFTT |
| 456 | PRT | Artificial | Luk572 | LPAPKNLVVSRVTEDSARLSWTAPDAAFDSF LIHYDEWENGGEAIVLTVPGSERSYDLTGLKP GTEYWVIIIGVKGGVRSNPLSAIFTT |

TABLE 6-continued

Nucleic Acid and Amino Acid Sequences of the Disclosure

| SEQ ID NO: | Type | Species | Description | Sequence |
|---|---|---|---|---|
| 457 | PRT | Artificial | Luk575 | LPAPKNLVVSRVTEDSARLSWTAPDAAFDSF PIFYVEIPQPGEAIVLTVPGSERSYDLTGLKPG TEYFVIIHGVKGGGISDPLSAIFTT |
| 458 | PRT | Artificial | Luk576 | LPAPKNLVVSRVTEDSARLSWTAPDAAFDSF VILYHEYWASGEAIVLTVPGSERSYDLTGLKP GTEYFVVIHGVKGGFLSDPLSAIFTT |
| 459 | PRT | Artificial | Luk577 | LPAPKNLVVSRVTEDSARLSWTAPDAAFDSF HIFYCEHWTSGEAIVLTVPGSERSYDLTGLKP GTEYFVAIHGVKGGEISAPLSAIFTT |
| 460 | PRT | Artificial | Luk578 | LPAPKNLVVSRVTEDSARLSWTAPDAAFDSF TIFYQEHLGYGEAIVLTVPGSERSYDLTGLKP GTEYVVVIHGVKGGWISSPLSAIFTT |
| 461 | PRT | Artificial | Luk579 | LPAPKNLVVSRVTEDSARLSWTAPDAAFDSF TIIYEETANGGEAIVLTVPGSERSYDLTGLKPG TEYFVVIHGVKGGHISSPLSAIFTT |
| 462 | PRT | Artificial | Luk580 | LPAPKNLVVSRVTEDSARLSWTAPDAAFDSF QIFYPETQKYGEAIVLTVPGSERSYDLTGLKP GTEYFVVIHGVKGGFISSPLSAIFTT |
| 463 | PRT | Artificial | Luk581 | LPAPKNLVVSRVTEDSARLSWTAPDAAFDSF VIFYGEYENGGEAIVLTVPGSERSYDLTGLKP GTEYFVIIVGVKGGFDSKPLSAIFTT |
| 464 | PRT | Artificial | Luk582 | LPAPKNLVVSRVTEDSARLSWTAPDAAFDSF NIFYHETVDKGEAIVLTVPGSERSYDLTGLKP GTEYFVVVSGVKGGYISDPLSAIFTT |
| 465 | PRT | Artificial | Luk583 | LPAPKNLVVSRVTEDSARLSWTAPDAAFDSF QIFYREESKYGEAIVLTVPGSERSYDLTGLKP GTEYFVPIHGVKGGEISDPLSAIFTT |
| 466 | PRT | Artificial | Luk584 | LPAPKNLVVSRVTEDSARLSWTAPDAAFDSF QIFYQEVVEWGEAIVLTVPGSERSYDLTGLKP GTEYFVVIHGVKGGWISDPLSAIFTT |
| 467 | PRT | Artificial | Luk585 | LPAPKNLVVSRVTEDSARLSWTAPDAAFDSF TIFYPETWIAGEAIVLTVPGSERSYDLTGLKPG TEYLVVIHGVKGGIISWPLSAIFTT |
| 468 | PRT | Artificial | Luk587 | LPAPKNLVVSRVTEDSARLSWTAPDAAFDSF VIPYQEYLGWGEAIVLTVPGSERSYDLTGLKP GTEYWVGIYGVKGGFISPPLSAIFTT |
| 469 | PRT | Artificial | Luk588 | LPAPKNLVVSRVTEDSARLSWTAPDAAFDSF AIFYYEHQVAGEAIVLTVPGSERSYDLTGLKP GTEYFVAIHGVKGGWISSPLSAIFTT |
| 470 | PRT | Artificial | Luk589 | LPAPKNLVVSRVTEDSARLSWTAPDAAFDSF TIIYAEEQRNGEAIVLTVPGSERSYDLTGLKPG TEYFVIIHGVKGGFISPPLSAIFTT |
| 471 | PRT | Artificial | Luk590 | LPAPKNLVVSRVTEDSARLSWTAPDAAFDSF SIFYLEERLTGEAIVLTVPGSERSYDLTGLKPG TEYLVVIHGVKGGVISDPLSAIFTT |
| 472 | PRT | Artificial | Luk592 | LPAPKNLVVSRVTEDSARLSWTAPDAAFDSF TIFYYEAVHQGEAIVLTVPGSERSYDLTGLKP GTEYFVVIHGVKGGNISVPLSAIFTT |
| 473 | PRT | Artificial | Luk593 | LPAPKNLVVSRVTEDSARLSWTAPDAAFDSF AIFYVELVWKGEAIVLTVPGSERSYDLTGLKP GTEYFVVIHGVKGGYISDPLSAIFTT |
| 474 | PRT | Artificial | Luk594 | LPAPKNLVVSRVTEDSARLSWTAPDAAFDSF VIHYGEYENGGEAIVLTVPGSERSYDLTGLKP GTEYFVAIHGVKGGFISDPLSAIFTT |

TABLE 6-continued

Nucleic Acid and Amino Acid Sequences of the Disclosure

| SEQ ID NO: | Type | Species | Description | Sequence |
|---|---|---|---|---|
| 475 | PRT | Artificial | Luk595 | LPAPKNLVVSRVTEDSARLSWTAPDAAFDSF TIIYFETKAYGEAIVLTVPGSERSYDLTGLKPG TEYWVIIHGVKGGYISVPLSAIFTT |
| 476 | PRT | Artificial | Luk596 | LPAPKNLVVSRVTEDSARLSWTAPDAAFDSF VIFYDEEWSKGEAIVLTVPGSERSYDLTGLKP GTEYAVFIYGVKGGAISEPLSAIFTT |
| 477 | PRT | Artificial | Luk597 | LPAPKNLVVSRVTEDSARLSWTAPDAAFDSF YIHYLETDPGGEAIVLTVPGSERSYDLTGLKP GTEYFVSIYGVKGGWISPPLSAIFTT |
| 478 | PRT | Artificial | Luk598 | LPAPKNLVVSRVTEDSARLSWTAPDAAFDSF VIFYDEDRPQGEAIVLTVPGSERSYDLTGLKP GTEYFVVIHGVKGGYLSIPLSAIFTT |
| 479 | PRT | Artificial | Luk599 | LPAPKNLVVSRVTEDSARLSWTAPDAAFDSF YIFYREETPHGEAIVLTVPGSERSYDLTGLKP GTEYWVLILGVKGGGISEPLSAIFTT |
| 480 | PRT | Artificial | Luk601 | LPAPKNLVVSRVTEDSARLSWTAPDAAFDSF TIFYIEDNKVGEAIVLTVPGSVRSYDLTGLKP GTEYFVVIHGVKGGIISEPLSAIFTT |
| 481 | PRT | Artificial | Luk602 | LPAPKNLVVSRVTEDSARLSWTAPDAAFDSF VIFYQELNRDGEAIVLTVPGSERSYDLTGLKP GTEYLVIIHGVKGGFISPPLSAIFTT |
| 482 | PRT | Artificial | Luk603 | LPAPKNLVVSRVTEDSARLSWTAPDAAFDSF HIFYLEFWYRGEAIVLTVPGSERSYDLTGLKP GTEYNVIIHGVKGGWISEPLSAIFTT |
| 483 | PRT | Artificial | Luk604 | LPAPKNLVVSRVTEDSARLSWTAPDAAFDSF QIFYGEWPQEGEAIVLTVPGSERSYDLTGLKP GTEYWVVILGVKGGQASPPLSAIFTT |
| 484 | PRT | Artificial | Luk605 | LPAPKNLVVSRVTEDSARLSWTAPDAAFDSF RIHYLEHAARGEAIVLTVPGSERSYDLTGLKP GTEYFVAIYGVKGGYISFPLSAIFTT |
| 485 | PRT | Artificial | Luk606 | LPAPKNLVVSRVTEDSARLSWTAPDAAFDSF TIHYLESYPRGEAIVLTVPGSERSYDLTGLKP GTEYFVAIYGVKGGYLSPPLSAIFTT |
| 486 | PRT | Artificial | Luk607 | LPAPKNLVVSRVTEDSARLSWTAPDAAFDSF QIFYHEWVPWGEAIVLTVPGSERSYDLTGLK PGTEYFVVIHGVKGGTISFPLSAIFTT |
| 487 | PRT | Artificial | Luk608 | LPAPKNLVVSRVTEDSARLSWTAPDAAFDSF NIFYGEYENGGEAIVLTVPGSERSYDLTGLKP GTEYFVFIIGVKGGPDSLPLSAIFTT |
| 488 | PRT | Artificial | Luk609 | LPAPKNLVVSRVTEDSARLSWTAPDAAFDSF DIRYWEGPGYGEAIVLTVPGSERSYDLTGLKP GTEYRVRIVGVKGGKRSEPLSAIFTT |
| 489 | PRT | Artificial | Luk610 | LPAPKNLVVSRVTEDSARLSWTAPDAAFDSF FIYYGEYDPVGEAIVLTVPGSERSYDLTGLKP GTEYFVIIQGVKGGQASGPLSAIFTT |
| 490 | PRT | Artificial | Luk611 | LPAPKNLVVSRVTEDSARLSWTAPDAAFDSF HIAYAEFWRYGEAIVLTVPGSERSYDLTGLKP GTEYWVNIAGVKGGEWSKPLSAIFTT |
| 491 | PRT | Artificial | Luk612 | LPAPKNLVVSRVTEDSARLSWTAPDAAFDSF TIFYQEESKYGEAIVLTVPGSERSYDLTGLKP GTEYFVVIHGVKGGAISQPLSAIFTT |
| 492 | PRT | Artificial | Luk613 | LPAPKNLVVSRVTEDSARLSWTAPDAAFDSF NIFYIETDKPGEAIVLTVPGSERSYDLTGLKPG TEYFVAIHGVKGGFISEPLSAIFTT |

TABLE 6-continued

Nucleic Acid and Amino Acid Sequences of the Disclosure

| SEQ ID NO: | Type | Species | Description | Sequence |
|---|---|---|---|---|
| 493 | PRT | Artificial | Luk614 | LPAPKNLVVSRVTEDSARLSWTAPDAAFDSF QIFYTEPVGHGEAIVLTVPGSERSYDLTGLKP GTEYFVAIHGVKGGTISPPLSAIFTT |
| 494 | PRT | Artificial | Luk615 | LPAPKNLVVSRVTEDSARLSWTAPDAAFDSF HIFYIEHRLQGEAIVLTVPGSERSYDLTGLKPG TEYLVLIHGVKGGFISPPLSAIFTT |
| 495 | PRT | Artificial | Luk616 | LPAPKNLVVSRVTEDSARLSWTAPDAAFDSF HIFYHEGLKSGEAIVLTVPGSERSYDLTGLKP GTEYLVVIHGVKGGTISNPLSAIFTT |
| 496 | PRT | Artificial | Luk617 | LPAPKNLVVSRVTEDSARLSWTAPDAAFDSF VIFYHETRVTGEAIVLTVPGSERSYDLTGLKP GTEYLVVIHGVKGGYISEPLSAIFTT |
| 497 | PRT | Artificial | Luk618 | LPAPKNLVVSRVTEDSARLSWTAPDAAFDSF SIFYQEAVEGGEAIVLTVPGSERSYDLTGLKP GTEYFVPIHGVKGGWISQPLSAIFTT |
| 498 | PRT | Artificial | Luk619 | LPAPKNLVVSRVTEDSARLSWTAPDAAFDSF QILYVEEFTRGEAIVLTVPGSERSYDLTGLKP GTEYVVIHGVKGGYISKPLSAIFTT |
| 499 | PRT | Artificial | Luk620 | LPAPKNLVVSRVTEDSARLSWTAPDAAFDSF TYIEALGFGEAIVLTVPGSERSYDLTGLKPGT EYFVAIYGVKGGYISEPLSAIFTT |
| 500 | PRT | Artificial | Luk621 | LPAPKNLVVSRVTEDSARLSWTAPDAAFDSF VIFYLEHWNPGEAIVLTVPGSERSYDLTGLKP GTEYLVPIHGVKGGSISPPLSAIFTT |
| 501 | PRT | Artificial | Luk622 | LPAPKNLVVSRVTEDSARLSWTAPDAAFDSF TIFYVEWEVVGEAIVLTVPGSERSYDLTGLKP GTEYFVVIHGVKGGVISNPLSAIFTT |
| 502 | PRT | Artificial | Luk623 | LPAPKNLVVSRVTEDSARLSWTAPDAAFDSF RIFYLEESKNGEAIVLTVPGSERSYDLTGLKP GTEYQVVIHGVKGGVISPPLSAIFTT |
| 503 | PRT | Artificial | Luk624 | LPAPKNLVVSRVTEDSARLSWTAPDAAFDSF AIFYNEDHKSGEAIVLTVPGSERSYDLTGLKP GTEYLVVIHGVKGGYISKPLSAIFTT |
| 504 | PRT | Artificial | Luk625 | LPAPKNLVVSRVPEDSARLSWTAPDAAFDSF LIDYQEWHEGEAIHLLVPGSERSYDLTGLKPG TEYAVIIVGVKGGKGSHPLSAIFTT |
| 505 | PRT | Artificial | Luk626 | LPAPKNLVVSRVTEDSARLSWTAPYAAFDSF WIGYYETTIPGEAIDLVVPGSERSYDLTGLKP GTEYGVGIDGVKGGRYSHPLSAIFTT |
| 506 | PRT | Artificial | Luk627 | LPAPKNLVVSRVTEDSARLSWTAPDAAFDSF AIFYKEEAIPGEAIALIVPGSERSYDLTGLKPG TEYFVPIHGVKGGYISTPLSAIFTT |
| 507 | PRT | Artificial | Luk628 | LPAPKNLVVSRVTEDSARLSWTAPDAAFDSF LIDYTELHNWGEAIHLFVPGSERSYDLTGLKP GTEYTVLIVGVKGGTGSIPLSAIFTT |
| 508 | PRT | Artificial | Luk629 | LPAPKNLVVSRVTEDSARLSWTAPDAAFDSF YITYEEEWWTGEAIFLDVPGSERSYDLTGLKP GTEYLVTIKGVKGGPWSQPLSAIFTT |
| 509 | PRT | Artificial | Luk630 | LPAPKNLVVSRVTEDSARLSWTAPDAAFDSF AIWYHEWGPVGEAILLYVPGSERSYDLTGLK PGTEYPVAIHGVKGGGTSHPLSAIFTT |
| 510 | PRT | Artificial | Luk631 | LPAPKNLVVSRVTEDSARLSWTAPDAAFDSF RIFYEELRYKGEAIWLFVPGSERSYDLTGLKP GTEYHVHIWGVKGGYFSRPLSAIFTT |

TABLE 6-continued

Nucleic Acid and Amino Acid Sequences of the Disclosure

| SEQ ID NO: | Type | Species | Description | Sequence |
|---|---|---|---|---|
| 511 | PRT | Artificial | Luk632 | LPAPKNLVVSRVTEDSARLSWTAPDAAFDSFI IDYWEQWNTGEAIHLYVPGSERSYDLTGLKP GTEYSVYIVGVKGGYASWPLSAIFTT |
| 512 | PRT | Artificial | Luk633 | LPAPKNLVVSRVTEDSARLSWTAPDAAFDSF WIGYDENHLYGEAIDLVVPGSERSYDLTGLK PGTEYTVSIAGVKGGLESFPLSAIFTT |
| 513 | PRT | Artificial | Luk634 | LPAPKNLVVSRVTEDSARLSWTAPEAAFDSF HISYWEFPLGGEAIGLWVPGSERSYDLTGLKP GTEYFVIIAGVKGGEFSNPLSAIFTT |
| 514 | PRT | Artificial | Luk635 | LPAPKNLVVSRVTEDSARLSWTAPDAAFDSFI IEYHEWFAKGEAIGLVVPGSERSYDLTGLKPG TEYSVIIVGVKGGAYSFPLSAIFTT |
| 515 | PRT | Artificial | Luk636 | LPAPKNLVVSRVTEDSARLSWTAPDAAFDSF LIDYWEGEFDGEAIHLFVPGSERSYDLTGLKP GTEYDVFIVGVKGGHGSDPLSAIFTT |
| 516 | PRT | Artificial | Luk637 | LPAPKNLVVSRVTEDSARLSWTAPDAAFDSF QIPYYELDSVGEAIVLTVPGSERSYDLTGLKP GTEYFVGIYGVKGGYISPPLSAIFTT |
| 517 | PRT | Artificial | Luk638 | LPAPKNLVVSRVTEDSARLSWTAPDAAFDSF YIGYGEYDPTGEAIVLTVPGSERSYDLTGLKP GTEYWVLISGVKGGYYSDPLSAIFTT |
| 518 | PRT | Artificial | Luk639 | LPAPKNLVVSRVTEDSARLSWTAPDAAFDSF VIYYLESVARGEAIVLTVPGSERSYDLTGLKP GTEYFVPIYGVKGGYISYPLSAIFTT |
| 519 | PRT | Artificial | Luk640 | LPAPKNLVVSRVTEDSARLSWTAPDAAFDSF TIPYWESYYSGEAIVLTVPGSERSYDLTGLKP GTEYVVAIYGVKGGYISSPLSAIFTT |
| 520 | PRT | Artificial | Luk641 | LPAPKNLVVSRVTEDSARLSWTAPDAAFDSF GIYYGEYHSGGEAIVLTVPGSERSYDLTGLKP GTEYFVLIDGVKGGLYSGPLSAIFTT |
| 521 | PRT | Artificial | Luk642 | LPAPKNLVVSRVTEDSARLSWTAPDAAFDSF YIVYAEYYWYGEAIVLTVPGSERSYDLTGLK PGTEYYVYIAGVKGGYGSDPLSAIFTT |
| 522 | PRT | Artificial | Luk643 | LPAPKNLVVSRVTEDSARLSWTAPDAAFDSF TIPYYESNLGGEAIVLTVPGSERSYDLTGLKP GTEYWVGIYGVKGGHISSPLSAIFTT |
| 523 | PRT | Artificial | Luk644 | LPAPKNLVVSRVTEDSARLSWTAPDAAFDSF TILYYELIDSGEAIVLTVPGSERSYDLTGLKPG TEYFVGIYGVKGGYISLPLSAIFTT |
| 524 | PRT | Artificial | Luk645 | LPAPKNLVVSRVTEDSARLSWTAPDAAFDSF WISYGEYWPSGEAIVLTVPGSERSYDLTGLKP GTEYFVLIRGVKGGDYSNPLSAIFTT |
| 525 | PRT | Artificial | Luk646 | LPAPKNLVVSRVTEDSARLSWTAPDAAFDSF RIFYGEYDGGGEAIVLTVPGSERSYDLTGLKP GTEYGVYIYGVKGGYISQPLSAIFTT |
| 526 | PRT | Artificial | Luk647 | LPAPKNLVVSRVTEDSARLSWTAPDAAFDSF SIYYGEWDPTGEAIVLTVPGSERSYDLTGLKP GTEYWVLIVGVKGGSTSAPLSAIFTT |
| 527 | PRT | Artificial | Luk648 | LPAPKNLVVSRVTEDSARLSWTAPDAAFDSF WIGYEEYYLVGEAIVLTVPGSERSYDLTGLKP GTEYLVWIKGVKGGYVGRPLSAIFTT |
| 528 | PRT | Artificial | Luk649 | LPAPKNLVVSRVTEDSARLSWTAPDAAFDSF GIAYSERVRYGEAIVLTVPGSERSYDLTGLKP GTEYWVGISGVKGGPYSEPLSAIFTT |

TABLE 6-continued

Nucleic Acid and Amino Acid Sequences of the Disclosure

| SEQ ID NO: | Type | Species | Description | Sequence |
|---|---|---|---|---|
| 529 | PRT | Artificial | Luk650 | LPAPKNLVVSRVTEDSARLSWTAPDAAFDSF TIHYYESYTVGEAIVLTVPGSERSYDLTGLKP GTEYWVGIYGVKGGYISEPLSAIFTT |
| 530 | PRT | Artificial | Luk651 | LPAPKNLVLSRVTEDSARLSWAQATYYQFDS FLIQYQESEKVGEAIVLTVPGSERSYDLTGLK PGTEYTVSIYGVLEVIPKLRYKVYSNPLSAIFT T |
| 531 | PRT | Artificial | Luk652 | LPAPKNLVVSRVTEDSARLSWSEVEDIPFDSF LIQYQESEKVGEAIVLTVPGSERSYDLTGLKP GTEYTVSIYGVLHYNRGQHPWHSNPLSAIFTT |
| 532 | PRT | Artificial | Luk653 | LPAPKNLVVSRVTEDSARLSWNLEVAFYFDS FLIQYQESEKVGEAIVLTVPGSERSYDLTGLK PGTEYTVSIYGVEHLDEVWWTANLSNPLSAIF TT |
| 533 | PRT | Artificial | Luk654 | LPAPKNLVVSRVTEDSARLSWSHFPNDWFDS FLIQYQESEKVGEAIVLTVPGSERSYDLTGLK PGTEYTVSIYGVHYWQFDIQSNPLSAIFTT |
| 534 | PRT | Artificial | Luk655 | LPAPKNLVVCRVTEDSARLSWRTYTSDAGFD SFLIQYQESEKVGEAIVLTVPGSERSYDLTGL KPGTEYTVSIYGVHEHAHIQYWHWSNPLSAI FTT |
| 535 | PRT | Artificial | Luk656 | LPAPKNLVVSRVTEDSARLSWKREQWANYF DSFLIQYQESEKVGEAIVLTVPGSERSYDLTG LKPGTEYTVSIYGVWEHLYKELWSYTSNPLS AIFTT |
| 536 | PRT | Artificial | Luk657 | LPAPKNLVVSRVTEDSARLSWSELEARTHFD SFLIQYQESEKVSEAIVLTVPGSERSYDLTGLK PGTEYTVSIYGVAQQLVAWRGSNPLSAIFTT |
| 537 | PRT | Artificial | Luk658 | LPAPKNLVVSRVTEDSARLSWKRARLDLPFD SFLIQYQESEKVGEAIVLTVPGSERSYDLTGL KPGTEYTVSIYGVDAWIPTVGSNPLSAIFTT |
| 538 | PRT | Artificial | Luk659 | LPAPKNLVVSRVTEDSARLSWINYWVLNYFD SFLIQYQESEKVGEAIVLTVPGSERSYDLTGL KPGTEYTVSIYGVEVWPQDHEWIDSNPLSAIF TT |
| 539 | PRT | Artificial | Luk660 | LPAPKNLVVSRVTEDSARLSWYREVDFTTFD SFLIQYQESEKVGEAIVLTVPGSERSYDLTGL KPGTEYTVSIYGVSSYYILHSNPLSAIFTT |
| 540 | PRT | Artificial | Luk661 | LPAPKNLVVSRVTEDSARLSWTAPDAAFDSF LITYREQIFAGEVIVLTVPGSERSYDLTGLKPG TEYPVCIYGVKGGPISDPLSAIFTT |
| 541 | PRT | Artificial | Luk662 | LPAPKNLVVSRVTEDSARLSWTAPDAAFDSF VINYREVINEGEAIILHVPGSERSYRPERSETG YRIHRHHSWC |
| 542 | PRT | Artificial | Luk663 | LPAPKNLVVSRVTEDSARLSWVVHNHLAFDS FLIQYQESEKVGEAIVLTVPGSERSYDLTGLK PGTEYTVSIYGVEPYVYAQYESNPLSAIFTT |
| 543 | PRT | Artificial | Luk664 | LPAPKNLVVSRVTEDSARLSWKRKSGAPFDS FLIQYQESEKVGEAIVLTVPGSERSYDLTGLK PGTEYTVSIYGVHGWDPGSDSNPLSAIFTT |
| 544 | PRT | Artificial | Luk665 | LPAPKNLVVSRVTEDSARLSWWHVRGHDFD SFLIQYQESEKVGEAIVLTVPGSERSYDLTGL KPGTEYTVSIYGVVWLPTTDSNPLSAIFTT |
| 545 | PRT | Artificial | Luk666 | LPAPKNLVVSRVTEDSARLSWSPDRARFDSF LIQYQESEKVGEAIVLTVPGSERSYDLTGLKP GTEYTVSIYGVWSWDNDDASNPLSAIFTT |

TABLE 6-continued

Nucleic Acid and Amino Acid Sequences of the Disclosure

| SEQ ID NO: | Type | Species | Description | Sequence |
|---|---|---|---|---|
| 546 | PRT | Artificial | Luk667 | LPAPKNLVVSRVTEDSARLSWFAGLQLFDSF LIQYQESEKVGEAIVLTVPGSERSYDLTGLKP GTEYTVSIYGVDWTVEEQSYHLWSNPLSAIFT T |
| 547 | PRT | Artificial | Luk668 | LPAPKNLVVSRVTEDSARLSWTIPHYTFDSFLI QYQESEKVGEAIVLTVPGSERSYDLTGLKPGT EYTVSIYGVPGKYIEPRWHFSNPLSAIFTT |
| 548 | PRT | Artificial | Luk669 | LPAPKNLVVSRVTEDSARLSWKRYSWLFDSF LIQYQESEKVGEAIVLTVPGSERSYDLTGLKP GTEYTVSIYGVLTWDPNDPSNPLSAIFTT |
| 549 | PRT | Artificial | Luk670 | LPAPKNLVVSRVTEDSARLSWKTIVTTIFDSF LIQYQESEKVGEAIVLTVPGSERSYDLTGLKP GTEYTVSIYGVDHRGFPFWQYWSSNPLSAIFT T |
| 550 | PRT | Artificial | Luk671 | LPAPKNLVVSRVTEDSARLSWYARRIYFDSFL IQYQESEKVGEAIVLTVPGSERSYDLTGLKPG TEYTVSIYGVETPNPYYDSNPLSAIFTT |
| 551 | PRT | Artificial | Luk672 | LPAPKNLVVSRVTEDSARLSWNLEQSTFDSFL IQYQESEKVGEAIVLTVPGSERSYDLTGLKPG TEYTVSIYGVTTYRITVPVRDHSNPLSAIFTT |
| 552 | PRT | Artificial | Luk673 | LPAPKNLVVSRVTEDSARLSWRAAGTGFDSF LIQYQESEKVGEAIVLTVPGSERSYDLTGLKP GTEYTVSIYGVNWQPDYWTWPSNPLSAIFTT |
| 553 | PRT | Artificial | Luk674 | LPAPKNLVVSRVTEDSARLSWPISHLSFDSFLI QYQESEKVGEAIVLTVPGSERSYDLTGLKPGT EYTVSIYGVWHQTVGRWFSNPLSAIFTT |
| 554 | PRT | Artificial | Luk675 | LPAPKNLVVSRVTEDSARLSWVRKKVNRFDS FLIQYQESEKVGEAIVLTVPGSERSYDLTGLK PGTEYTVSIYGVRNWKPNDPSNPLSAIFTT |
| 555 | PRT | Artificial | Luk676 | LPAPKNLVVSRVTEDSARLSWVSATQHPFDS FLIQYQESEKVGEAIVLTVPGSERSYDLTGLK PGTEYTVSIYGVDNWDPTDPSNPLSAIFTT |
| 556 | PRT | Artificial | Luk677 | LPAPKNLVVSRVTEDSARLSWPIALRDFDSFL IQYQESEKVGEAIVLTVPGSERSYDLTGLKPG TEYTVSIYGVISWDPTDPSNPLSAIFTT |
| 557 | PRT | Artificial | Luk678 | LPAPKNLVVSRVTEDSARLSWWDAEWFAPH FDSFLIQYQESEKVGEAIVLTVPGSERSYDLT GLKPGTEYTVSIYGVGLLKWPNYAVLSNPLS AIFTT |
| 558 | PRT | Artificial | Luk679 | LPAPKNLVVSRVTEDSARLSWPNNQRYYQPF DSFLIQYQESEKVGEAIVLTVPGSERSYDLTG LKPGTEYTVSIYGVLSWNPHHWSNPLSAIFTT |
| 559 | PRT | Artificial | Luk680 | LPAPKNLVVSRVTEDSARLSWYDARVTDEFF DSFLIQYQESEKVGEAIVLTVPGSERSYDLTG LKPGTEYTVSIYGVDDLLTNHLLAISNPLSAIF TT |
| 560 | PRT | Artificial | Luk681 | LPAPKNLVVSRVTEDSARLSWKKRNTLKIFD SFLIQYQESEKVGEAIVLTVPGSERSYDLTGL KPGTEYTVSIYGVETWDPNDWSNPLSAIFTT |
| 561 | PRT | Artificial | Luk682 | LPAPKNLVVSRVTEDSARLSWLNRVKPNDFD SFLIQYQESEKVGEAIVLTVPGSERSYDLTGL KPGTEYTVSIYGVITWHPGHWSNPLSAIFTT |
| 562 | PRT | Artificial | Luk683 | LPAPKNLVVSRVTEDSARLSWLTVRFTKFEF DSFLIQYQESEKVGEAIVLIVPGSERSYDLTGL KPGTEYTVSIYGVRSSKPRASNPLSAIFTT |

TABLE 6-continued

Nucleic Acid and Amino Acid Sequences of the Disclosure

| SEQ ID NO: | Type | Species | Description | Sequence |
|---|---|---|---|---|
| 563 | PRT | Artificial | Luk684 | LPAPKNLVVSRVTEDSARLSWPNYRKVVSVF DSFLIQYQESEKVGEAIVLTVPGSERSYDLTG LKPGTEYTVSIYGVHTWHPGHYSNPLSAIFTT |
| 564 | PRT | Artificial | Luk685 | LPAPKNLVVSRVTEDSARLSWGNRQQVRSAF DSFLIQYQESEKVGEAIVLTVPGSERSYDLTG LKPGTEYTVSIYGVVGWHPNHPSNPLSAIFTT |
| 565 | PRT | Artificial | Luk686 | LPARKTWLFLVLPKTLRVCLGPRRTRRSTLFG LRTQRLLSGGKRLACWCRVLNVLTT |
| 566 | PRT | Artificial | Luk687 | LPARKTWLFLVLPKTLRVCLGPRRTRRSTLSG LHTQRRHPGVKRSA |
| 567 | PRT | Artificial | Luk688 | LPAPKNLVVSRVTEDSARLSWTAPDAAFDSF GIEGGEYYYVGEAIVLTVPGSERSYDLTGLKP GTEYGVPIGGVKGGPNSHPLSAIFTT |
| 568 | PRT | Artificial | Luk689 | LPAPKNLVVSRVTEDSARLSWWFYLTSWFAF DSFLIQYQESEKVGEAIVLTVPGSERSYDLTG LKPGTEYTVSIYGVLKVDPHVRSNPLSAIFTT |
| 569 | PRT | Artificial | Luk690 | LPAPKNLVVSRVTEDSARLSWYHVNFGFFDS FLIQYQESEKVGEAIVLTVPGSERSYDLTGLK PGTEYTVSIYGVYEDYPVIIFNNRSNPLSAIFT T |
| 570 | PRT | Artificial | Luk691 | LPAPKNLVVSRVTEDSARLSWEDIKNKRFDSF LIQYQESEKVGEAIVLTVPGSERSYDLTGLKP GTEYTVSIYGVRGLANPFRVSNPLSAIFTT |
| 571 | PRT | Artificial | Luk692 | LPAPKNLVVSRVTEDSARLSWWRYGPWFHF DSFLIQYQESEKVGEAIVLTVPGSERSYDLTG LKPGTEYTVSIYGVRTHVRPPQWVSNPLSAIF TT |
| 572 | PRT | Artificial | Luk693 | LPAPKAAVSRVTEDSARLSWWRYGPWFHF DSFLIQYQESEKVGEAIVLTVPGSERSYDLTG LKPGTEYTVSIYGVRTHVRPPQWVSNPLSAIF TT |
| 573 | PRT | Artificial | Luk694 | LPAPKNLGCFSCYRRLCPSVLD |
| 574 | PRT | Artificial | Luk695 | LPAPKNLVVSRVTEDSARLSWLNWEQYITFD SFLIQYQESEKVGEAIVLTVPGSERSYDLTGL KPGTEYTVSIYGVWIIRDRSHWLNPSNPLSAIF TT |
| 575 | PRT | Artificial | Luk696 | LPAPKNLWLFLVLPKTLPVCLGGVMARGSTS TLS |
| 576 | PRT | Artificial | Luk697 | LPAPKNLVVSRVTEDSARLSWERFGPWFHFD SFLIQYQESEKVGEAIVLTVPGSERSYDLTGL KPGTEYTVSIYGVKTQPEQEFKSNPLSAIFTT |
| 577 | PRT | Artificial | Luk698 | LPAPKNPGCFSCYRRLCPSVLVALWPVVPLR LFPDPVPGIRKSW |
| 578 | PRT | Artificial | Luk699 | LPAPKNLVVSRVTEDSARLSWWRYGPWFHF DSFLIQYQESEKVGEAIVLTVPGSERSYDLTG LKPGTEYTVSIYGVKQHHSLFHSNPLSAIFTT |
| 579 | PRT | Artificial | Luk700 | LPAPKNLVVSRVTEDSARLSWNQQLNYQYF DSFLIQYQESEKVGEAIVLTVPGSERSYDLTG LKPGTEYTVSIYGVWYRWWSGSNPLSAIFTT |
| 580 | PRT | Artificial | Luk701 | LPAPKNLVVSRVTEDSARLSWWRYGPWFHF DSFLIQYQESEKVGEAIVLTVPGSERSYDLTG LKPGTEYTVSIYGVRTHNNQPGHYTSNPLSAI FTT |
| 581 | PRT | Artificial | Luk702 | LPAPTKNGCFSCYRRLCPSVLVALWPVVPLR LFPDPVPGIRKSW |

TABLE 6-continued

Nucleic Acid and Amino Acid Sequences of the Disclosure

| SEQ ID NO: | Type | Species | Description | Sequence |
|---|---|---|---|---|
| 582 | PRT | Artificial | Luk703 | LPAPKALVVSRVTEDSARLSWWRYGPWFHF DSFLIQYQESEKVGEAIVLTVPGSERSYDLTG LKPGTEYTVSIYGVRTHVRPPQWVSNPLSAIF TT |
| 583 | PRT | Artificial | Luk704 | LPAPKNLVVSRVTEDSARLSWTAPDAAFDSF PILYQERWWKGEAIVLTVPGSERSYDLTGLK PGTEYGVPITGVKGGGVSFPLSAIFTT |
| 584 | PRT | Artificial | Luk705 | LPAPKNLVVSRVTEDSARLSWTAPDAAFDSF HIWYRESWYFGEAIVLTVPGSERSYDLTGLKP GTEYYVVIRGVKGGSLSWPLSAIFTT |
| 585 | PRT | Artificial | Luk706 | LPAPKNLVVSRVTEDSARLSWTAPDAAFDSF PISYYEQPRRGEAIWLFVPGSERSYDLTGLKP GTEYTVYITGVKGGTWSFPLTATFTT |
| 586 | PRT | Artificial | Luk707 | LPAPKNLVVSRVTEDSARLSWTAPDAAFDSF GIEYYETKTKGEAINLFVPGSERSYDLTGLKP GTEYYVIILGVKGGEPSSPLVAPFTT |
| 587 | PRT | Artificial | Luk708 | LPAPKNLVVSRVTEDSARLSWKDVGEWKFD SFLIQYQESEKVGEAIVLTVPGSERSYDLTGL KPGTEYTVSIYGVHQLTITYSPTSNPLSAIFTT |
| 588 | PRT | Artificial | Luk709 | LPAPKNLVVSRVTEDSARLSWKRSYHPNFDS FLIQYQESEKVGEAIVLTVPGSERSYDLTGLK PGTEYTVSIYGVIDVPTVYHPGRSNPLSAIFTT |
| 589 | PRT | Artificial | Luk710 | LPAPKNLVVSRVTEDSARLSWLKKVSKFDSF LIQYQESEKVGEAIVLTVPGSERSYDLTGLKP GTEYTVSIYGVGEFPDRIYWGASNPLSAIFTT |
| 590 | PRT | Artificial | Luk711 | LPAPKNLVVSRVTEDSARLSWYYWVQTIFDS FLIQYQESEKVGEAIVLTVPGSERSYDLTGLK PGTEYTVSIYGVGNLPDIFYKLPSNPLSAIFTT |
| 591 | PRT | Artificial | Luk712 | LPAPKNLVVSRVTEDSARLSWSKKLENFDSF LIQYQESEKVGEAIVLTVPGSERSYDLTGLKP GTEYTVSIYGVYHTHLIFSNPLSAIFTT |
| 592 | PRT | Artificial | Luk713 | LPAPKNLVVSRVTEDSARLSWHDLTIWPFDSF LIQYQESEKVGEAIVLTVPGSERSYDLTGLKP GTEYTVSIYGVVIEFEAWSNPLSAIFTT |
| 593 | PRT | Artificial | Luk714 | LPAPKNLVVSRVTEDSARLSWFPWTEWSAFD SFLIQYQESEKVGEAIVLTVPGSERSYDLTGL KPGTEYTVSIYGVENWLVLATATWSNPLSAIF TT |
| 594 | PRT | Artificial | Luk715 | LPAPKNLVVSRVTEDSARLSWVEWWIRPIEF DSFLIQYQESEKVGEAIVLTVPGSERSYDLTG LKPGTEYTVSIYGVWQQLYVEILISNPLSAIFT T |
| 595 | PRT | Artificial | Luk716 | LPAPKNLVVSRVTEDSARLSWSSQRTLPREFD SFLIQYQESEKVGEAIVLTVPGSERSYDLTGL KPGTEYTVSIYGVHVIIHSGSSNPLSAIFTT |
| 596 | PRT | Artificial | Luk717 | LPAPKNLVVSRVTEDSARLSWTSRLEDFWFD SFLIQYQESEKVGEAIVLTVPGSERSYDLTGL KPGTEYTVSIYGVGSEVYFRYYEHWSNPLSAI FTT |
| 597 | PRT | Artificial | Luk718 | LPAPKNLVVSRVTEDSARLSWQVNRNAQFHF DSFLIQYQESEKVGEAIVLTVPGSERSYDLTG LKPGTEYTVSIYGVAHPKLVWFAPPSNPLSAI FTT |
| 598 | PRT | Artificial | Luk719 | LPAPKNLVVSRVTEDSARLSWTFLEKWFIFDS FLIQYQESEKVGEAIVLTVPGSERSYDLTGLK PGTEYTVSIYGVVKHHDHDPEYPSNPLSAIFT T |

TABLE 6-continued

Nucleic Acid and Amino Acid Sequences of the Disclosure

| SEQ ID NO: | Type | Species | Description | Sequence |
|---|---|---|---|---|
| 599 | PRT | Artificial | Luk720 | LPAPKNLVVSRVTEDSARLSWRHPRIQGGHF DSFLIQYQESEKVGEAIVLTVPGSERSYDLTG LKPGTEYTVSIYGVIHPFWWSPSNPLSAIFTT |
| 600 | PRT | Artificial | Luk721 | LPAPKNLVVSRVTEDSARLSWYNAKKITPFF DSFLIQYQESEKVGEAIVLTVPGSERSYDLTG LKPGTEYTVSIYGVYPEVQHTTSNPLSAIFTT |
| 601 | PRT | Artificial | Luk722 | LPAPKNLVVSRVTEDSARLSWTEPWQEFDSF LIQYQESEKVGEAIVLTVPGSERSYDLTGLKP GTEYTVSIYGVILPTLHKSNPLSAIFTT |
| 602 | PRT | Artificial | Luk723 | LPAPKNLVVSRVTEDSARLSWYRFPRIHFDSF LIQYQESEKVGEAIVLTVPGSERSYDLTGLKP GTEYTVSIYGVHTNIDLHNYNYLSNPLSAIFT T |
| 603 | PRT | Artificial | Luk724 | LPAPKNLVVSRVTEDSARLSWAERHPWFDSF LIQYQESEKVGEAIVLTVPGSERSYDLTGLKP GTEYTVSIYGVLRQNINIQDTNYSNPLSAIFTT |
| 604 | PRT | Artificial | Luk725 | LPAPKNLVVSRVTEDSARLSWPWWEGWTFD SFLIQYQESEKVGEAIVLTVPGSERSYDLTGL KPGTEYTVSIYGVKIRTLKASRSNPLSAIFTT |
| 605 | PRT | Artificial | Luk726 | LPAPKNLVVSRVTEDSARLSWAANFIDFDSFL IQYQESEKVGEAIVLTVPGSERSYDLTGLKPG TEYTVSIYGVYSPKLRWDLLNYSNPLSAIFTT |
| 606 | PRT | Artificial | Luk727 | LPAPKNLVVSRVTEDSARLSWFKQEFEFDSFL IQYQESEKVGEAIVLTVPGSERSYDLTGLKPG TEYTVSIYGVYYPEYYPREPWPSNPLSAIFTT |
| 607 | PRT | Artificial | Luk728 | LPAPKNLVVSRVTEDSARLSWEDEGTQFDSF LIQYQESEKVGEAIVLTVPGSERSYDLTGLKP GTEYTVSIYGVHWYWYWQRSNPLSAIFTT |
| 608 | PRT | Artificial | Luk729 | LPAPKNLVVSRVTEDSARLSWFGNQTGARSF DSFLIQYQESEKVGEAIVLTVPGSERSYDLTG LKPGTEYTVSIYGVYYQFRRTVRNSNPLSAIF TT |
| 609 | PRT | Artificial | Luk730 | LPAPKNLVVSRVTEDSARLSWGENRFVLSFD SFLIQYQESEKVGEAIVLTVPGSERSYDLTGL KPGTEYTVSIYGVLYHARHTWWLQQSNPLSA IFTT |
| 610 | PRT | Artificial | Luk731 | LPAPKNLVVSRVTEDSARLSWEKQQLKKWSF DSFLIQYQESEKVGEAIVLTVPGSERSYDLTG LKPGTGYTVSIYGVEHSNTRKRHSNPLSAIFT T |
| 611 | PRT | Artificial | Luk732 | LPAPKNLVVSRVTEDSARLSWKINDNSGYFD SFLIQYQESEKVGEAIVLTVPGSERSYDLTGL KPGTEYTVSIYGVAHRYENNPTLWSNPLSAIF TT |
| 612 | PRT | Artificial | Luk733 | LPAPKNLVVSRVTEDSARLSWPAFRWQPPGF DSFLIQYQESEKVGEAIVLTVPGSERSYDLTG LKPGTEYTVSIYGVGGFLYPWNYPTSNPLSAI FTT |
| 613 | PRT | Artificial | Luk734 | LPAPKNLVVSRVTEDSARLSWISEKPTTSLFD SFLIQYQESEKVGEAIVLTVPGSERSYDLTGL KPGTEYTVSIYGVWPRAIHYAYWFNSNPLSAI FTT |
| 614 | PRT | Artificial | Luk735 | LPAPKNLVVSRVTEDSARLSWQKSFQLTPFDS FLIQYQESEKVGEAIVLTVPGSERSYDLTGLK PGTEYTVSIYGVVVEYKWAATNPSNPLSAIFT T |

TABLE 6-continued

Nucleic Acid and Amino Acid Sequences of the Disclosure

| SEQ ID NO: | Type | Species | Description | Sequence |
|---|---|---|---|---|
| 615 | PRT | Artificial | Luk736 | LPAPKNLVVSRVTEDSARLSWNASLNANHFD SFLIQYQESEKVGEAIVLTVPGSERSYDLTGL KPGTEYTVSIYGVVTSESNYGSNPLSAIFTT |
| 616 | PRT | Artificial | Luk737 | LPAPKNLVVSRVTEDSARLSWTNTARLNKFD SFLIQYQESEKVGEAIVLTVPGSERSYDLTGL KPGTEYTVSIYGVAITHSHHHHSSNPLSAIFTT |
| 617 | PRT | Artificial | Luk738 | LPAPKNLVVSRVTEDSARLSWTAPDAAFDSF HILYWEPTPIGEAILLNVPGSERSYDLTGLKPG TEYNVEIDGVKGGNPSDPLSAIFTT |
| 618 | PRT | Artificial | Luk739 | LPAPKNLVVSRVTEDSARLSWTAPDAAFDSF SISYREGGQHGEAIVLTVPGSERSYDLTGLKP GTEYSVYILGVKGGDESEPLSAIFTT |
| 619 | PRT | Artificial | Luk740 | LPAPKNLVVSRVTEDSARLSWPWWNKHFDS FLIQYQESEKVGEAIVLTVPGSERSYDLTGLK PGTEYTVSIYGVIQWKKKPFSNPLSAIFTT |
| 620 | PRT | Artificial | Luk741 | LPAPKNLVVSRVTEDSARLSWPWWNKHFDS FLIQYQESEKVGEAIVLTVPGSERSYDLTGLK PGTEYTVSIYGVEHDWYLLNYAESNPLSAIF TT |
| 621 | PRT | Artificial | Luk742 | LPAPKNLVVSRVTEDSARLSWWAFSYLQFDS FLIQYQESEKVGEAIVLTVPGSERSYDLTGLK PGTEYTVSIYGVVEVRENSWNHSSNPLSAIFT T |
| 622 | PRT | Artificial | Luk743 | LPAPKNLVVSRVTEDSARLSWRETHNPQFDS FLIQYQESEKVGEAIVLTVPGSERSYDLTGLK PGTEYTVSIYGVIQWKKKPFSNPLSAIFTT |
| 623 | PRT | Artificial | Luk744 | LPAPKNLVVSRVTEDSARLSWTTRVDEFDSF LIQYQESEKVGEAIVLTVPGSERSYDLTGLKP GTEYTVSIYGVKWYNWKKNVNTESNPLSAIF TT |
| 624 | PRT | Artificial | Luk745 | LPAPKNLVVSRVTEDSARLSWSQKDINFFDSF LIQYQESEKVGEAIVLTVPGSERSYDLTGLKP GTEYTVSIYGVLWYNWKKNWDNSNPLSAIFT T |
| 625 | PRT | Artificial | Luk746 | LPAPKNLVVSRVTEDSARLSWFTTNNHWFDS FLIQYQESEKVGEAIVLTVPGSERSYDLTGLK PGTEYTVSIYGVIQWKKKPFSNPLSAIFTT |
| 626 | PRT | Artificial | Luk747 | LPAPKNLVVSRVTEDSARLSWGRAREPASFD SFLIQYQESEKVGEAIVLTVPGSERSYDLTGL KPGTEYTVSIYGVLTVLFIDSSNPLSAIFTT |
| 627 | PRT | Artificial | Luk748 | LPAPKNLVVSRVTEDSVRLSWYNWKKKRLK FDSFLIQYQESEKVGEAIVLTVPGSERSYDLT GLKPGTEYTVSIYGVPNLWDIWNWVLSNPLS AIFTT |
| 628 | PRT | Artificial | Luk749 | LPAPKNLVVSRVTEDSARLSWGTFNLEVYIFD SFLIQYQESEKVGEAIVLTVPGSERSYDLTGL KPGTEYTVSIYGVVSANWHGHSNPLSAIFTT |
| 629 | PRT | Artificial | Luk750 | LPAPKNLVVSRVTEDSARLSWPQIFNELWEF DSFLIQYQESEKVGEAIVLTVPGSERSYDLTG LKPGTEYTVSIYGVWWYNRKKKRQSNPLSAI FTT |
| 630 | PRT | Artificial | Luk751 | LPAPKNLVVSRVTEDSARLSWYNEQKKPINF DSFLIQYQESEKVGEAIVLTVPGSERSYDLTG LKPGTEYTVSIYGVWWYNRKKKRQSNPLSAI FTT |

TABLE 6-continued

Nucleic Acid and Amino Acid Sequences of the Disclosure

| SEQ ID NO: | Type | Species | Description | Sequence |
|---|---|---|---|---|
| 631 | PRT | Artificial | Luk752 | LPAPKNLVVSRVTEDSARLSWRGKYSVVDFDSFLIQYQESEKVGEAIVLTVPGSERSYDLTGLKPGTEYTVSIYGVPWYNWKKKYVISNPLSAIFTT |
| 632 | PRT | Artificial | Luk753 | LPAPKNLVVSRVTEDSARLSWYNTKKNPVFDSFLIQYQESEKVGEAIVLTVPGSERSYDLTGLKPGTEYTVSIYGVWLIKSLNAWFSNPLSAIFTT |
| 633 | PRT | Artificial | Luk754 | LPAPKNLVVSRVTEDSARLSWTAPDAAFDSFVIIYEEVQWRGEAIRLFVPGSERSYDLTGLKPGTEYDVNIRGVKGGGSSAPLSAIFTT |
| 634 | PRT | Artificial | Luk755 | LPAPKNLVVSRVTEDSARLSWYNWKKKPGYFDSFLIQYQESEKVGEAIVLTVPGSERSYDLTGLKPGTEYTVSIYGVVHYHEWLASNPLSAIFTT |
| 635 | PRT | Artificial | Luk756 | LPAPKNLVVSRVTEDSARLSWYTVKKKPQKFDSFLIQYQESEKVGEAIVLTVPGSERSYDLTGLKPGTEYTVSIYGVLDAYPIAEWPAQSNPLSAIFTT |
| 636 | PRT | Artificial | Luk757 | LPAPKNLVVSRVTEDSARLSWYNTKKKPQFDSFLIQYQESEKVGEAIVLTVPGSERSYDLTGLKPGTEYTVSIYGVNEFILRWEGSNPLSAIFTT |
| 637 | PRT | Artificial | Luk758 | LPAPKNLVVSRVTEDSARLSWTAPDAAFDSFYIGYYELIGAGEAIVLTVPGSERSYDLTGLKPGTEYGVGIQGVKGGSYSAPLSAIFTT |
| 638 | PRT | Artificial | Luk759 | LPAPKNLVVSRVTEDSARLSWYDRKVEFDSFLIQYQESEKVGEAIVLTVPGSERSYDLTGLKPGTEYTVSIYGVGDGWGYLLLVSNPLSAIFTT |
| 639 | PRT | Artificial | Luk760 | LPAPKNLVVSRVTEDSARLSWIVPRTFHFDSFLIQYQESEKVGEAIVLTVPGSERSYDLTGLKPGTEYTVSIYGVWSQYITHWLPKSNPLSAIFTT |
| 640 | PRT | Artificial | Luk761 | LPAPKNLVVSRVTEDSARLSWNYRVATFDSFLIQYQESEKVGEAIVLTVPGSERSYDLTGLKPGTEYTVSIYGVSVELLSSNPLSAIFTT |
| 641 | PRT | Artificial | Luk762 | LPAPKNLVVSRVTEDSARLSWQPHRYEFYQFDSFLIQYQESEKVGEAIVLTVPGSERSYDLTGLKPGTEYTVSIYGVADFEFELHSNPLSAIFTT |
| 642 | PRT | Artificial | Luk763 | LPAPKNLVVSRVTEDSARLSWIPSYHLFAFDSFLIQYQESEKVGEAIVLTVPGSERSYDLTGLKPGTEYTVSIYGVNDAEQRYHHSNPLSAIFTT |
| 643 | PRT | Artificial | Luk764 | LPAPKNLVVSRVTEDSARLSWPINKTTSPFDSFLIQYQESEKVGEAIVLTVPGSERSYDLTGLKPGTEYTVSIYGVVEAHYDAFISNPLSAIFTT |
| 644 | PRT | Artificial | Luk765 | LPAPKNLVVSRVTEDSARLSWRKKLWEAEFDSFLIQYQESEKVGEAIVLTVPGSERSYDLTGLKPGTEYTVSIYGVILPDSFHVHHCNPLSAIFTT |
| 645 | PRT | Artificial | Luk766 | LPAPKNLVVSRVTEDSARLSWKRPQWRRLFDSFLIQYQESEKVGEAIVLTVPGSERSYDLTGLKPGTEYTVSIYGVGNWPASVSSNPLSAIFTT |
| 646 | PRT | Artificial | Luk767 | LPAPKNLVVSRVTEDSARLSWIWDAIGPHFFDSFLIQYQESEKVGEAIVLTVPGSERSYDLTGLKPGTEYTVSIYGVSWFIRITASNPLSAIFTT |
| 647 | PRT | Artificial | Luk768 | LPAPKNLVVSRVTEDSARLSWRGLEPRWGFDSFLIQYQESEKVGEAIVLTVPGSERSYDLTGLKPGTEYTVSIYGVPWYEHLRILNATSNPLSAIFTT |

TABLE 6-continued

Nucleic Acid and Amino Acid Sequences of the Disclosure

| SEQ ID NO: | Type | Species | Description | Sequence |
|---|---|---|---|---|
| 648 | PRT | Artificial | Luk769 | LPAPKNLVVSRVTEDSARLSWDWWSNPIKFD SFLIQYQESEKVGEAIVLTVPGSERSYDLTGL KPGTEYTVSIYGVINWHWYQTHRTSNPLSAIF TT |
| 649 | PRT | Artificial | Luk770 | LPAPKNLVVSRVTEDSARLSWEQWHAGVNP FDSFLIQYQESEKVGEAIVLTVPGSERSYDLT GLKPGTEYTVSIYGVSYYVRVLQFALFSNPLS AIFTT |
| 650 | PRT | Artificial | Luk771 | LPAPKNLVVSRVTEDSARLSWAQVETQIHFD SFLIQYQESEKVGESDLLTVPGSERSYDLTGL KPGTEYTVSIYGVSHYRRHVPRHSNPLSAIFT T |
| 651 | PRT | Artificial | Luk772 | LPAPKNLVVSRVTEDSARLSWIAYYYGQTFD SFLIQYQESEKVGEAIVLTVPGSERSYDLTGL KPGTEYTVSIYGVWHENYAKWPDPSNPLSAI FTT |
| 652 | PRT | Artificial | Luk773 | LPAPKNLVVSRVTEDSARLSWWHWLTHHFF DSFLIQYQESEKVGEAIVLTVPGSERSYDLTG LKPGTEYTVSIYGVFFRWQDPLHDLISNPLSAI FTT |
| 653 | PRT | Artificial | Luk774 | LPAPKNLVVSRVTEDSARLSWKYKEHFQIFD SFLIQYQESEKVGEAIVLTVPGSERSYDLTGL KPGTEYTVSIYGVERIWWQYRSNPLSAIFTT |
| 654 | PRT | Artificial | Luk775 | LPAPKNLVVSRVTEDSARLSWVGDAYFNHLF DSFLIQYQESEKVGEAIVLTVPGSERSYDLTG LKPGTEYTVSIYGVEARPKPRLSNPLSAIFTT |
| 655 | PRT | Artificial | Luk776 | LPAPKNLVVSRVTEDSARLSWNKRVPNFDSF LIQYQESEKVGEAIVLTVPGSERSYDLTGLKP GTEYTVSIYGVIQWKKKPFSNPLSAIFTT |
| 656 | PRT | Artificial | Luk777 | LPAPKNLVVSRVTEDSARLSWYNEQKKRSFF DSFLIQYQESEKVGEAIVLTVPGSERSYDLTG LKPGTEYTVSIYGVPIRRSGWDVRSNPLSAIFT T |
| 657 | PRT | Artificial | Luk778 | LPAPKNLVVSRVTEDSARLSWYNTKKKPVFD SFLIQYQESEKVGEAIVLTVPGSERSYDLTGL KPGTEYTVSIYGVKVDDWPDYWQSNPLSAIF TT |
| 658 | PRT | Artificial | Luk779 | LPAPKNLVVSRVTEDSARLSWYNVKKTFQFD SFLIQYQESEKVGEAIVLTVPGSERSYDLTGL KPGTEYTVSIYGVAAVWYTPNTQSNPLSAIFT T |
| 659 | PRT | Artificial | Luk780 | LPAPKNLVVSRVTEDSARLSWYNSKKKVQFD SFLIQYQESEKVGEAIVLTVPGSERSYDLTGL KPGTEYTVSIYGVIESHWWQLKWPSNPLSAIF TT |
| 660 | PRT | Artificial | Luk781 | LPAPKNLVVSRVTEDSARLSWYNTKKKTAFF DSFLIQYQESEKVGEAIVLTVPGSERSYDLTG LKPGTEYTVSIYGVDEVGYLHIETSNPLSAIFT T |
| 661 | PRT | Artificial | Luk782 | LPAPKNLVVSRVTEDSARLSWYNEKKIFQFD SFLIQYQESEKVGEAIVLTVPGSERSYDLTGL KPGTEYTVSIYGAKGPNFPSQNDPSSNPLSAIF TT |
| 662 | PRT | Artificial | Luk783 | LPAPKNLVVSRVTEDSARLSWYNWKKKRLK FDSFLIQYQESEKVGEAIVLTVPGSERSYDLT GLKPGTEYTVSIYGVASPVYTGLYLGSNPLSA IFTT |

TABLE 6-continued

Nucleic Acid and Amino Acid Sequences of the Disclosure

| SEQ ID NO: | Type | Species | Description | Sequence |
|---|---|---|---|---|
| 663 | PRT | Artificial | Luk784 | LPAPKNLVVSRVTEDSARLSWYTVKKKPQKF DSFLIQYQESEKVGEAIVLTVPGSERSYDLTG LKPGTEYTVSIYGVGDQLLEIGRTGSNPLSAIF TT |
| 664 | PRT | Artificial | Luk785 | LPAPKNLVVSRVTEDSARLSWTAPDAAFDSF FIGYREVPFLGEAIVLTVPGSERSYDLTGLKPG TEYIVLIWGVKGGIPSQPLSAIFTT |
| 665 | PRT | Artificial | Luk786 | LPAPKNLVVSRVTEDSARLSWTAPDAAFDSF FIPYREEAPLGEAIVLTVPGSERSYDLTGLKPG TEYDVIIVGVKGGYPSKPLSAIFTT |
| 666 | PRT | Artificial | Luk787 | LPAPKNLVVSRVTEDSARLSWTAPDAAFDSF WIVYHELVHSGEAIVLTVPGSERSYDLTGLKP GTEYPVFIVGVKGGWYSPPLSAIFTT |
| 667 | PRT | Artificial | TCL24 | LPAPKNLVVSRVTEDSARLSWTAPDAAF DSFXIXYXEXXXXGEAIXLXVPGSERSYD LTGLKPGTEYXVXIXGVKGGXXSXPLXA XFTT |

SEQUENCE LISTING (667 sequences)

SEQ ID NO: 1 - protein, 89 aa, Artificial
  Tencon
LPAPKNLVVSRVTEDSARLSWTAPDAAFDSFLIQYQESEKVGEAINLTVPGSERSYDLTGLKPGTEYTVSIYGVKGGHRSNPLSAEFTT

SEQ ID NO: 2 - protein, 20 aa, Artificial
  Linker
GGGGSGGGGSGGGGSGGGGS

SEQ ID NO: 3 - protein, 6 aa, Artificial
  Tencon BC loop
TAPDAA

SEQ ID NO: 4 - protein, 7 aa, Artificial
  Tencon FG loop
KGGHRSN

SEQ ID NO: 5 - DNA, 21 bp, Artificial
  POP2222 primer
cggcggttagaacgcggctac

SEQ ID NO: 6 - DNA, 30 bp, Artificial
  POP2250 primer
cggcggttagaacgcggctacaattaatac

SEQ ID NO: 7 - DNA, 22 bp, Artificial
  DidLigRev primer
catgattacgccaagctcagaa

SEQ ID NO: 8 - DNA, 63 bp, Artificial
  MDD40 primer
agccgccgccaccggttaatggtgatggtgatggtgaccaccggtggtgaagatcgcagacag

SEQ ID NO: 9 - DNA, 58 bp, Artificial
  MDD62 primer
aagaaggagaaccggtatgctgccggcgccgaaaaacctggttgtttctcgtgttacc

SEQ ID NO: 10 - protein, 330 aa, S. aureus
HHHHHHNSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKAG

SEQ ID NO: 11 - protein, 309 aa, S. aureus
KINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 12 - protein, 323 aa, S. aureus
MGSSHHHHHHSSGLVPAGSHMLAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWVGNNYKNQNTVTFTSTYEVDWQNHTVKLIGTDSKETNPGV

SEQ ID NO: 13 - protein, 305 aa, S. aureus
MGSSHHHHHHSSGLVPAGSHMLNTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 14 - protein, 89 aa, Artificial
  leukotoxin binding domain Luk17
LPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 15 - protein, 94 aa, Artificial
  leukotoxin binding domain Luk19
LPAPKNLVVSRVTEDSARLSWYHAIHRLNHFDSFLIQYQESEKVGEAIVLTVPGSERSYDLAGLKPGTEYTVSIYGVLPDAFVSSNPLSAIFTT

SEQ ID NO: 16 - protein, 94 aa, Artificial
  leukotoxin binding domain Luk20
LPAPKNLVVSRVTEDSARLSWYHAIHRLNHFDSFLIQYQESEKVGEAIVLTVPGSERSYDLTGLKPGTEYTVSIYGVLPDAFVSSNPLSAIFTT

SEQ ID NO: 17 - protein, 89 aa, Artificial
  leukotoxin binding domain Luk24
LPAPKNLVVSRVTEDSARLSWTAPDAAFDSFQIGYFELWPNGEAIVLTVPGSERSYDLTGLKPGTEYEVFIRGVKGGLYSYPLSAIFTT

SEQ ID NO: 18 - protein, 97 aa, Artificial
  leukotoxin binding domain Luk8
LPAPKNLVVSRVTEDSARLSWKRKPWAPIFDSFLIQYQESEKVGEAIVLTVPGSERSYDLTGLKPGTEYTVSIYGVWDHAGPKYEIESNPLSAIFTT

SEQ ID NO: 19 - protein, 95 aa, Artificial
  leukotoxin binding domain Luk9
LPAPKNLVVSRVTEDSARLSWDRTYSLLNYFDSFLIQYQESEKVGEAIVLTVPGSERSYDLTGLKPGTEYTVSIYGVGGQHPTYESNPLSAIFTT

SEQ ID NO: 20 - protein, 97 aa, Artificial
  leukotoxin binding domain Luk10
LPAPKNLVVSRVTEDSARLSWAASENAFVFDSFLIQYQESEKVGEAIVLTVPGSERSYDLTGLKPGTEYTVSIYGVGGKLHNQFEWLSNPLSAIFTT

SEQ ID NO: 21 - protein, 94 aa, Artificial
  leukotoxin binding domain Luk11
LPAPKNLVVSRVTEDSARLSWRAKPWAPKFDSFLIQYQESEKVGEAIVLTVPGSERSYDLTGLKPGTEYTVSIYGVSAIKPGHTSNPLSAIFTT

SEQ ID NO: 22 - protein, 94 aa, Artificial
  leukotoxin binding domain Luk12
LPAPKNLVVSRVTEDSARLSWRAKPWAPKFDSFLIQYQESEKVGEAIVLTVPGSERSYDLTGLKPGTEYTVSIYGVKASEKFIESNPLSAIFTT

SEQ ID NO: 23 - protein, 97 aa, Artificial
  leukotoxin binding domain Luk21
LPAPKNLVVSRVTEDSARLSWVTKPWAEYFDSFLIQYQESEKVGEAIVLTVPGSERSYDLTGLKPGTEYTVSIYGVWDHAGPKYEIESNPLSAIFTT

SEQ ID NO: 24 - protein, 94 aa, Artificial
  leukotoxin binding domain Luk22
LPAPKNLVVSRVTEDSARLSWRAKPWAPKFDSFLIQYQESEKVGEAIVLTVPGSERSYDLTGLKPGTEYAVSIYGVKASEKFIESNPLSAIFTT

SEQ ID NO: 25 - protein, 89 aa, Artificial
  leukotoxin binding domain Luk26
LPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 26 - protein, 89 aa, Artificial
  leukotoxin binding domain Luk27
LPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 27 - protein, 89 aa, Artificial
  leukotoxin binding domain Luk28
LPAPKNLVVSRVTEDSARLSWTAPDAAFDSFAIQYWEWWPPGEAIVLTVPGSERSYDLTGLKPGTEYGVIILGVKGGWYSNPLSAIFTT

SEQ ID NO: 28 - protein, 97 aa, Artificial
  leukotoxin binding domain Luk29
LPAPKNLVVSRVTEDSARLSWDEQFVSNFDSFLIQYQESEKVGEAIVLTVPGSERSYDLTGLKPGTEYTVSIYGVFVPWDGFSEINYSNPLSAIFTT

SEQ ID NO: 29 - protein, 95 aa, Artificial
  leukotoxin binding domain Luk30
LPAPKNLVVSRVTEDSARLSWAFNWNYFAFDSFLIQYQESEKVGEAIVLTVPGSERSYDLTGLKPGTEYTVSIYGVVALNTGNKKSNPLSAIFTT

SEQ ID NO: 30 - protein, 99 aa, Artificial
  leukotoxin binding domain Luk31
LPAPNNLVVSRVTEDSARLSWDWDKYYTNRFDSFLIQYQESEKVGEAIVLTVPGSERSYDLTGLKPGTEYTVSIYGVLVRDYIRAAEWYSNPLSAIFTT

SEQ ID NO: 31 - protein, 96 aa, Artificial
  leukotoxin binding domain Luk32
LPAPKNLVVSRVTEDSARLSWYHENAYLLFDSFLIQYQESEKVGEAIVLTVPGSERSYDLTGLKPGTEYTVSIYGVVYDLTPEKRSSNPLSAIFTT

SEQ ID NO: 32 - protein, 93 aa, Artificial
  leukotoxin binding domain Luk33
LPAPKNLVVSRVTEDSARLSWTAPDAAFDSFLIQYQESEKVGEAIVLTVPGSERSYDLTGLKPGTEYTVSIYGVAFIPDEIEFSNPLSAIFTT

SEQ ID NO: 33 - protein, 93 aa, Artificial
  leukotoxin binding domain Luk34
LPAPKNLVVSRVTEDSARLSWTAPDAAFDSFLIQYQESEKVGEAIVLTVPGSERSYDLTGPKPGTEYTVSIYGVVVVPHEFEFSNPLSAIFTT

SEQ ID NO: 34 - protein, 93 aa, Artificial
  leukotoxin binding domain Luk35
LPAPKNLVVSRVTEDSARLSWTAPDAAFDSFLIQYQESEKVGEAIVLTVPGSERSYDLTGLKPGTEYTVSIYGVAHIPWEFEWSKPLSAIFTT

SEQ ID NO: 35 - protein, 93 aa, Artificial
  leukotoxin binding domain Luk36
LPAPKNLVVSRVTEDSARLSWTAPDAAFDSFLIQYQESEKVGEAIVLTVPGSERSYDLTGLKPGTEYTVSIYGVADVPDEYEFSNPLSAIFTT

SEQ ID NO: 36 - protein, 92 aa, Artificial
  leukotoxin binding domain Luk37
LPAPKNLVVSRVTEDSARLSWTAPDAAFDSFLIQYQESEKVGEAIVLTVPGSERSYDLTGLKPGTEYTVSIYGVVGWPLFIQSNPLSAIFTT

SEQ ID NO: 37 - protein, 96 aa, Artificial
  leukotoxin binding domain Luk38
LPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 38 - protein, 96 aa, Artificial
  leukotoxin binding domain Luk39
LPAPKNLVVSRVTEDSARLSWTAPDAAFDSFLIQYQESEKVGEAIVLTVPGSERSYDLTGLKPGTEYTVSIYGVRVFYFSVEPTWFSNPLSAIFTT

SEQ ID NO: 39 - protein, 95 aa, Artificial
  leukotoxin binding domain Luk40
LPAPKNLVVSRVTEDSARLSWTAPDAAFDSFLIQYQESEKVGEAIVLTVPGSERSYDLTGLKPGTEYTVSIYGVSYAGEPLLWIYSNPLSAIFTT

SEQ ID NO: 40 - protein, 94 aa, Artificial
  leukotoxin binding domain Luk41
LPAPKNLVVSRVTEDSARLSWTAPDAAFDSFLIQYQESEKVGEAIVLTVPGSERSYDLTGLKPGTEYTVSIYGVSEVPYSEYWFSNPLSAIFTT

SEQ ID NO: 41 - protein, 94 aa, Artificial
  leukotoxin binding domain Luk42
LPAPKNLVVSRVTEDSARLSWTAPDAAFDSFLIQYQESEKVGEAIVLTVPGSERSYDLTGLKPGTEYTVSIYGVVWGYRLTTEHSNPLSAIFTT

SEQ ID NO: 42 - protein, 95 aa, Artificial
  leukotoxin binding domain Luk43
LPAPKNLVVSRVTEDSARLSWTAPDAAFDSFLIQYQESEKVGEAIVLTVPGSERSYDLTGLKPGTEYTVSIYGVNSFGRPTLNLFSNPLSAIFTT

SEQ ID NO: 43 - protein, 95 aa, Artificial
  leukotoxin binding domain Luk44
LPAPKNLVVSRVTEDSARLSWTAPDAAFDSFLIQYQESEKVGEAIVLTVPGSERSYDLTGLKPGTEYTVSIYGVEWLQYYGETLFSNPLSAIFTT

SEQ ID NO: 44 - protein, 95 aa, Artificial
  leukotoxin binding domain Luk45
LPAPKNLVVSRVTEDSARLSWTAPDAAFDSFLIQYQESEKVGEAIVLTVPGSERSYDLTGLKPGTEYTVSIYGVAWLTNAYEWEFSNPLSAIFTT

SEQ ID NO: 45 - protein, 89 aa, Artificial
  leukotoxin binding domain Luk46
LPAPKNLVVSRVTEDSARLSWTAPDAAFDSFWIHYEESTWAGEAIVLTVPGSERSYDLTGLKPGTEYGVVIVGVKGGLKSHPLSAIFTT

SEQ ID NO: 46 - protein, 89 aa, Artificial
  leukotoxin binding domain Luk47
LPAPKNLVVSRVTEDSARLSWTAPDAAFDSFGIQYFETTESGEAIVLTVPGSERSYDLTGLKPGTEYVVFISGVKGGPLSWPLSAIFTT

SEQ ID NO: 47 - protein, 89 aa, Artificial
  leukotoxin binding domain Luk48
LPAPKNLVVSRVTEDSARLSWTAPDAAFDSFHIEYGEWWPTGEAIVLTVPGSERSYDLTGLKPGTEYGVLIVGVKGGFRSSPLSAIFTT

SEQ ID NO: 48 - protein, 89 aa, Artificial
  leukotoxin binding domain Luk49
LPAPKNLVVSRVTEDSARLSWTAPDAAFDSFAIVYAEHWPAGEAIVLTVPGSERSYDLTGLKPGTEYNVTIPGVKGGKYSDPLSAIFTT

SEQ ID NO: 49 - protein, 89 aa, Artificial
  leukotoxin binding domain Luk50
LPAPKNLVVSRVTEDSARLSWTAPDAAFDSFVIPYSEWWPVGEAIVLTVPGSERSYDLTGLKPGTEYGVYIVGVKGGTWSAPLSAIFTT

SEQ ID NO: 50 - protein, 89 aa, Artificial
  leukotoxin binding domain Luk51
LPAPKNLVVSRVTEDSARLSWTAPDAAFDSFQIHYFESEPGGEAIVLTVPGSERSYDLTGLKPGTEYVVFIIGVKGGWSSLPLSAIFTT

SEQ ID NO: 51 - protein, 89 aa, Artificial
  leukotoxin binding domain Luk52
LPAPKNLVVSRVTEDSARLSWTAPDAAFDSFWIQYGEAQEFGEAIVLTVPGSERSYDLTGLKPGTEYIVFITGVKGGNKSYPLSAIFTT

SEQ ID NO: 52 - protein, 89 aa, Artificial
  leukotoxin binding domain Luk53
LPAPKNLVVSRVTEDSARLSWTAPDAAFDSFTIQYFEAEANGEAIVLTVPGSERSYDLTGLKPGTEYLVFIVGVKGGHSSLPLSAIFTT

SEQ ID NO: 53 - protein, 89 aa, Artificial
  leukotoxin binding domain Luk54
LPAPKNLVVSRVTEDSARLSWTAPDAVFDSFRIEYSEWWPIGEAIVLTVPGSERSYDLTGLKPGTEYGVVIAGVKGGGYSVPLSAIFTT

SEQ ID NO: 54 - protein, 89 aa, Artificial
  leukotoxin binding domain Luk55
LPAPKNLVVSRVTEDSARLSWTAPDAAFDSFWIQYFESAGEGEAIVLTVPGSERSYDLTGLKPGTEYLVFIVGVKGGVPSYPLSAIFTT

SEQ ID NO: 55 - protein, 88 aa, Artificial
  leukotoxin binding domain Luk56
LPAPKNLVVSRVTEDSARLSWTAPDAAFDSFYIQYIELEIGEAIVLTVPGSERSYDLTGLKPGTEYGVFISGVKGGWNSYPLSAIFTT

SEQ ID NO: 56 - protein, 89 aa, Artificial
  leukotoxin binding domain Luk57
LPAPKNLVVSRVTEDSARLSWTAPDAAFNSFYIEYFEWFPAGEAIVLTVPGSERSYDLTGLKPGTEYAVIIHGVKGGQRSTPLSAIFTT

SEQ ID NO: 57 - protein, 89 aa, Artificial
  leukotoxin binding domain Luk58
LPAPKNLVVSRVTEDSARLSWTAPDAAFDSFDIEYDESAHFGEAIVLTVPGSERSYDLTGLKPGTEYIVFIYGVKGGYASIPLSAIFTT

SEQ ID NO: 58 - protein, 89 aa, Artificial
  leukotoxin binding domain Luk59
LPAPKNLVVSRVTEDSARLSWTAPDAAFDSFDISYNEFAWSGEAIVLTVPGSERSYDLTGLKPGTEYVVYIHGVKGGPTSYPLSAIFTT

SEQ ID NO: 59 - protein, 89 aa, Artificial
  leukotoxin binding domain Luk60
LPAPKNLVVSRVTEDSARLSWTAPDAAFDSFDIQYWEWWPFGEAIVLTVPGSERSYDLTGLKPGTEYGVIILGVKGGFRSTPLSAIFTT

SEQ ID NO: 60 - protein, 450 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 214 aa, Homo sapiens
EIVLTQSPATLSLSPGERATLSCRASQSVSGYLGWYQQKPGQAPRLLIYGASSRATGIPDRFSGSGSGTDFTLTISRLEPEDFAVYYCQQYGSSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - protein, 449 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 214 aa, Homo sapiens; identical to SEQ ID NO: 61

SEQ ID NO: 64 - protein, 450 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 65 - protein, 214 aa, Homo sapiens; identical to SEQ ID NO: 61

SEQ ID NO: 66 - protein, 449 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 67 - protein, 214 aa, Homo sapiens; identical to SEQ ID NO: 61

SEQ ID NO: 68 - protein, 449 aa, Artificial; identical to SEQ ID NO: 66
  CR5133 PRASA A6 LC-D Heavy Chain

SEQ ID NO: 69 - protein, 328 aa, Artificial
  CR5133 PRASA A6 LC-D Light Chain
EIVLTQSPATLSLSPGERATLSCRASQSVSGYLGWYQQKPGQAPRLLIYGASSRATGIPDRFSGSGSGTDFTLTISRLEPEDFAVYYCQQYGSSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSLPAPKNLVVSRVTEDSARLSWRAKPWAPKFDSFLIQYQESEKVGEAIVLTVPGSERSYDLTGLKPGTEYTVSIYGVKASEKFIESNPLSAIFTT

SEQ ID NO: 70 - protein, 559 aa, Artificial
  CR5133 PRASA A6 HC-AB Heavy Chain
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 71 - protein, 214 aa, Artificial; identical to SEQ ID NO: 61
  CR5133 PRASA A6 HC-AB Light Chain

SEQ ID NO: 72 - protein, 559 aa, Artificial; identical to SEQ ID NO: 70
  CR5133 PRASA A6 LC-D HC-AB Heavy Chain

SEQ ID NO: 73 - protein, 328 aa, Artificial; identical to SEQ ID NO: 69
  CR5133 PRASA A6 LC-D HC-AB Light Chain

SEQ ID NO: 74 - protein, 563 aa, Artificial
  CR5133 PRASA A6 HC-D Heavy Chain
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWRAKPWAPKFDSFLIQYQESEKVGEAIVLTVPGSERSYDLTGLKPGTEYTVSIYGVKASEKFIESNPLSAIFTT

SEQ ID NO: 75 - protein, 214 aa, Artificial; identical to SEQ ID NO: 61
  CR5133 PRASA A6 HC-D Light Chain

SEQ ID NO: 76 - protein, 673 aa, Artificial
  CR5133 PRASA A6 HC AB-D Heavy Chain
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSLPAPKNLVVSRVTEDSARLSWRAKPWAPKFDSFLIQYQESEKVGEAIVLTVPGSERSYDLTGLKPGTEYTVSIYGVKASEKFIESNPLSAIFTT

SEQ ID NO: 77 - protein, 214 aa, Artificial; identical to SEQ ID NO: 61
  CR5133 PRASA A6 HC AB-D Light Chain

SEQ ID NO: 78 - protein, 673 aa, Artificial
  CR5133 PRASA A6 HC D-AB Heavy Chain
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWRAKPWAPKFDSFLIQYQESEKVGEAIVLTVPGSERSYDLTGLKPGTEYTVSIYGVKASEKFIESNPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 79 - protein, 214 aa, Artificial; identical to SEQ ID NO: 61
  CR5133 PRASA A6 HC D-AB Light Chain

SEQ ID NO: 80 - DNA, 376 bp, Artificial
  synthetic tencon fragment BC6
  misc_feature (198)..(215): n is a, c, g, or t
gtgacacggcggttagaacgcggctacaattaatacataaccccatccccctgttgacaattaatcatcggctcgtataatgtgtggaattgtgagcggataacaatttcacacaggaaacaggatctaccatgctgccggcgccgaaaaacctggttgtttctgaagttaccgaagactctctgcgtctgtcttggnnnnnnnnnnnnnnnnnnttygactctttcctgatccagtaccaggaatctgaaaaagttggtgaagcgatcaacctgaccgttccgggttctgaacgttcttacgacctgaccggtctgaaaccgggtaccgaatacaccgtttctatctacggtgttcttagaagcttcccaaaggc

SEQ ID NO: 81 - DNA, 379 bp, Artificial
  synthetic tencon fragment BC7
  misc_feature (198)..(218): n is a, c, g, or t
gtgacacggcggttagaacgcggctacaattaatacataaccccatccccctgttgacaattaatcatcggctcgtataatgtgtggaattgtgagcggataacaatttcacacaggaaacaggatctaccatgctgccggcgccgaaaaacctggttgtttctgaagttaccgaagactctctgcgtctgtcttggnnnnnnnnnnnnnnnnnnnnnttygactctttcctgatccagtaccaggaatctgaaaaagttggtgaagcgatcaacctgaccgttccgggttctgaacgttcttacgacctgaccggtctgaaaccgggtaccgaatacaccgtttctatctacggtgttcttagaagcttcccaaaggc

SEQ ID NO: 82 - DNA, 382 bp, Artificial
  synthetic tencon fragment BC8
  misc_feature (198)..(221): n is a, c, g, or t
gtgacacggcggttagaacgcggctacaattaatacataaccccatccccctgttgacaattaatcatcggctcgtataatgtgtggaattgtgagcggataacaatttcacacaggaaacaggatctaccatgctgccggcgccgaaaaacctggttgtttctgaagttaccgaagactctctgcgtctgtcttggnnnnnnnnnnnnnnnnnnnnnnnnttygactctttcctgatccagtaccaggaatctgaaaaagttggtgaagcgatcaacctgaccgttccgggttctgaacgttcttacgacctgaccggtctgaaaccgggtaccgaatacaccgtttctatctacggtgttcttagaagcttcccaaaggc

SEQ ID NO: 83 - DNA, 385 bp, Artificial
  synthetic tencon fragment BC9
  misc_feature (198)..(224): n is a, c, g, or t
gtgacacggcggttagaacgcggctacaattaatacataaccccatccccctgttgacaattaatcatcggctcgtataatgtgtggaattgtgagcggataacaatttcacacaggaaacaggatctaccatgctgccggcgccgaaaaacctggttgtttctgaagttaccgaagactctctgcgtctgtcttggnnnnnnnnnnnnnnnnnnnnnnnnnnnttygactctttcctgatccagtaccaggaatctgaaaaagttggtgaagcgatcaacctgaccgttccgggttctgaacgttcttacgacctgaccggtctgaaaccgggtaccgaatacaccgtttctatctacggtgttcttagaagcttcccaaaggc

SEQ ID NO: 84 - DNA, 131 bp, Artificial
  synthetic 130mer-L17A fragment
cggcggttagaacgcggctacaattaatacataaccccatccccctgttgacaattaatcatcggctcgtataatgtgtggaattgtgagcggataacaatttcacacaggaaacaggatctaccatgctg

SEQ ID NO: 85 - DNA, 30 bp, Artificial; identical to SEQ ID NO: 6
  POP2222ext primer

SEQ ID NO: 86 - DNA, 81 bp, Artificial
  LS1114 primer
ccaagacagacgggcagagtcttcggtaacgcgagaaacaaccaggtttttcggcgccggcagcatggtagatcctgtttc

SEQ ID NO: 87 - DNA, 26 bp, Artificial
  LS1115 primer
ccgaagactctgcccgtctgtcttgg

SEQ ID NO: 88 - DNA, 45 bp, Artificial
  LS1117 primer
cagtggtctcacggattcctggtactggatcaggaaagagtcgaa

SEQ ID NO: 89 - DNA, 54 bp, Artificial
  SDG10 primer
catgcggtctcttccgaaaaagttggtgaagcgatcgtcctgaccgttccgggt

SEQ ID NO: 90 - DNA, 29 bp, Artificial
  SDG24 primer
ggtggtgaagatcgcagacagcgggttag

SEQ ID NO: 91 - DNA, 61 bp, Artificial
  SDG28 primer
aagatcagttgcggccgctagactagaaccgctgccaccgccggtggtgaagatcgcagac

SEQ ID NO: 92 - protein, 89 aa, Artificial
  tencon library TCL19
  MISC_FEATURE (32)..(32): Xaa is any amino acid except cysteine or methionine
  MISC_FEATURE (34)..(34): Xaa is any amino acid except cysteine or methionine
  MISC_FEATURE (36)..(36): Xaa is any amino acid except cysteine or methionine
  MISC_FEATURE (38)..(41): Xaa is any amino acid except cysteine or methionine
  MISC_FEATURE (68)..(68): Xaa is any amino acid except cysteine or methionine
  MISC_FEATURE (70)..(70): Xaa is any amino acid except cysteine or methionine
  MISC_FEATURE (72)..(72): Xaa is any amino acid except cysteine or methionine
  MISC_FEATURE (78)..(79): Xaa is any amino acid except cysteine or methionine
  MISC_FEATURE (81)..(81): Xaa is any amino acid except cysteine or methionine
LPAPKNLVVSRVTEDSARLSWTAPDAAFDSFXIXYXEXXXXGEAIVLTVPGSERSYDLTGLKPGTEYXVXIXGVKGGXXSXPLSAIFTT

SEQ ID NO: 93 - protein, 9 aa, Artificial
  tencon library TCL19 C strand
  MISC_FEATURE (4)..(4): Xaa is any amino acid except cysteine or methionine
  MISC_FEATURE (6)..(6): Xaa is any amino acid except cysteine or methionine
  MISC_FEATURE (8)..(8): Xaa is any amino acid except cysteine or methionine
DSFXIXYXE

SEQ ID NO: 94 - protein, 10 aa, Artificial
  tencon library TCL19 F strand
  MISC_FEATURE (4)..(4): Xaa is any amino acid except cysteine or methionine
  MISC_FEATURE (6)..(6): Xaa is any amino acid except cysteine or methionine
  MISC_FEATURE (8)..(8): Xaa is any amino acid except cysteine or methionine
TEYXVXIXGV

SEQ ID NO: 95 - protein, 15 aa, Artificial
  tencon library TCL19 C strand + CD loop
  MISC_FEATURE (4)..(4): Xaa is any amino acid except cysteine or methionine
  MISC_FEATURE (6)..(6): Xaa is any amino acid except cysteine or methionine
  MISC_FEATURE (8)..(8): Xaa is any amino acid except cysteine or methionine
  MISC_FEATURE (10)..(13): Xaa is any amino acid except cysteine or methionine
DSFXIXYXEXXXXGE

SEQ ID NO: 96 - protein, 17 aa, Artificial
  tencon library TCL19 F strand + FG loop
  MISC_FEATURE (4)..(4): Xaa is any amino acid except cysteine or methionine
  MISC_FEATURE (6)..(6): Xaa is any amino acid except cysteine or methionine
  MISC_FEATURE (8)..(8): Xaa is any amino acid except cysteine or methionine
  MISC_FEATURE (14)..(15): Xaa is any amino acid except cysteine or methionine
  MISC_FEATURE (17)..(17): Xaa is any amino acid except cysteine or methionine
TEYXVXIXGVKGGXXSX

SEQ ID NO: 97 - protein, 28 aa, Artificial
  tencon library TCL19 A strand + AB loop + B strand + BC loop
  MISC_FEATURE (6)..(6): Xaa is any amino acid except cysteine or methionine
  MISC_FEATURE (8)..(8): Xaa is any amino acid except cysteine or methionine
  MISC_FEATURE (10)..(11): Xaa is any amino acid except cysteine or methionine
  MISC_FEATURE (13)..(16): Xaa is any amino acid except cysteine or methionine
  MISC_FEATURE (18)..(18): Xaa is any amino acid except cysteine or methionine
  MISC_FEATURE (20)..(20): Xaa is any amino acid except cysteine or methionine
  MISC_FEATURE (22)..(22): Xaa is any amino acid except cysteine or methionine
LPAPKXLXVXXVXXXXAXLXWXAPDAAF

SEQ ID NO: 98 - protein, 5 aa, Artificial
  tencon library TCL19 E strand
  MISC_FEATURE (1)..(1): Xaa is any amino acid except cysteine or methionine
  MISC_FEATURE (3)..(3): Xaa is any amino acid except cysteine or methionine
XYXLT

SEQ ID NO: 99 - protein, 533 aa, S. aureus
MKETAAAKFERQHMDSPDLGTLVPRGSMAMNYFVGNSLGVNLTGIEKAIINRLNLFKEMGRPAQCVFLSWNRYLYRNAQNYITSSDYINMYDFFQEATYLERNEPFDWLSYWTDECHYTLKHVENSHDFRIYDQERFLMYAHFQDPKYRILDYVNHFDSQRRKVKRDFYDVRGFLSCSRILVDKQQTLCEFFYNPEDDTKLEKYFSYKDGKPEVQKIIVYYANKQYFFNNETELGAFFIKQLYQHGDLFFSDRNVYTAPIFNLTPESIPVVAVLHSTHIKNIDALDSSPFKNVYKAMFENLSRYRAIIVSTEQQKLDVEKRINHTIPVVNIPVGYSETIDTPVQTLDQRSVKLISVARYSPEKQLHQQIELIKRLVSYVPKIELHMYGFGSESKKLNELIQKYGLENHVYLRGFLSNLDQEYSDAYLSLITSNMEGFSLALLESLAHGVPVISYDIKYGPNELITSDFNGYLITKNDEDALFDKVKYVIDHPEVQQRLSKGSLAKAQQYSKASLIKQWDQFVRLILEHHHHHH

SEQ ID NO: 100 - protein, 868 aa, S. aureus
MAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALEHHHHHH

SEQ ID NO: 101 - protein, 319 aa, S. aureus
MTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGLEHHHHHH

SEQ ID NO: 102 - protein, 453 aa, Homo sapiens
EVMLVESGGGLVQPKGSLKLSCAASGFTFNNYAMNWVRQAPGKGLEWVARIRSKSNNYATFYADSVKDRFTISRDDSQSMLYLQMNNLKTEDTAMYYCVRRGASGIDYAMDYWGQGTSLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 213 aa, Homo sapiens
DIVLSQSPAILSASPGEKVTMTCRASSSVNYMHWYQQKPGSSPKPWISATSNLASGVPARFSGSGSGTSYSLTISRVEAEDAATYYCQQWSSNPPTFGGGTMLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 104 - protein, 450 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 218 aa, Homo sapiens
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 106 - protein, 450 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - protein, 218 aa, Homo sapiens
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSLPVTKSFNRGEC

SEQ ID NO: 108 - protein, 291 aa, S. aureus
NSAHHHHHHGSENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 109 - protein, 310 aa, S. aureus
NSAHHHHHHGSEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 110 - protein, 297 aa, S. aureus
NSAHHHHHHGSANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 111 - protein, 312 aa, S. aureus
NSAHHHHHHGSAQHITPVSEKKVDDKITLYKTTATSDSDKLKISQILTFNFIKDKSYDKDTLILKAAGNIYSGYTKPNPKDTISSQFYWGSKYNISINSDSNDSVNVVDYAPKNQNEEFQVQQTVGYSYGGDINISNGLSGGGNGSKSFSETINYKQESYRTSLDKRTNFKKIGWDVEAHKIMNNGWGPYGRDSYHSTYGNEMFLGSRQSNLNAGQNFLEYHKMPVLSRGNFNPEFIGVLSRKQNAAKKSKITVTYQREMDRYTNFWNQLHWIGNNYKDENRATHTSIYEVDWENHTVKLIDTQSKEKNPMS

SEQ ID NO: 112 - protein, 295 aa, S. aureus
NSAHHHHHHGSDNNIENIGDGAEVVKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVERQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 113 - protein, 95 aa, Artificial
  leukotoxin binding domain Luk82
LPAPKNLVVSRVTEDSARLSWSNRAITTFDSFLIQYQESEKVGEAIVLTVPGSERSYDLTGLKPGTEYTVSIYGVEYRFRPKYTGSNPLSAIFTT

SEQ ID NO: 114 - protein, 94 aa, Artificial
  leukotoxin binding domain Luk83
LPAPKNLVVSRVTEDSARLSWFRPSEDISSFDSFLIQYQESEKVGEAIVLTVPGSERSYDLTGLKPGTEYTVSIYGVAFPTDAKSNPLSAIFTT

SEQ ID NO: 115 - protein, 89 aa, Artificial
  leukotoxin binding domain Luk85
LPAPKNLVVSRVTEDSARLSWTAPDAAFDSFHINYNEEALVGEAIVLTVPGSERSCDLTGLKPGTEYGVEIEGVKGGPWSWPLSAIFTT

SEQ ID NO: 116 - protein, 89 aa, Artificial
  leukotoxin binding domain Luk86
LPAPKNLVVSRVTEDSARLSWTAPDAAFDSFYIRYNEIDLHGEAIVLTVPGSERSYDLTGLKPGTEYQVPIAGVKVCIISKPLSAIFTT

SEQ ID NO: 117 - protein, 94 aa, Artificial
  leukotoxin binding domain Luk87
LPAPKNLVVSRVTEDSARLSWANTEPSYFAFDSFLIQYQESEKVGEAIVLTVPGSERSYDLTGLKPGTEYTVSIYGVVWVTWGKSNPLSAIFTT

SEQ ID NO: 118 - protein, 97 aa, Artificial
  leukotoxin binding domain Luk88
LPAPKNLVVSRVTEDSARLSWTLEWSLIFDSFLIQYQESEKVGEAIVLTVPGSERSYDLTGLKPGTEYTVSIYGVQRSVAWYFLLLASNPLSAIFTT

SEQ ID NO: 119 - protein, 92 aa, Artificial
  leukotoxin binding domain Luk90
LPAPKNLVVSRVTEDSARLSWRTYPTLFDSFLIQYQESEKVGEAIVLTVPGSERSYDLTGLKPGTEYTVSIYGVWPRNIQPWSNPLSAIFTT

SEQ ID NO: 120 - protein, 96 aa, Artificial
  leukotoxin binding domain Luk92
LPAPKNLVVSRVTEDSARLSWKRVKWVSYQFDSFLIQYQESEKVGEAIVLTVPGSERSYDLTGLKPGTEYTVSIYGVASIDETVGVSNPLSAIFTT

SEQ ID NO: 121 - protein, 93 aa, Artificial
  leukotoxin binding domain Luk93
LPAPKNLVVSRVTEDSARLSWWRRISRFDSFLIQYQESEKVGEAIVLTVPGSERSYDLTGLKPGTEYTVSIYGVDREVYDEWSSNPLSAIFTT

SEQ ID NO: 122 - protein, 97 aa, Artificial
  leukotoxin binding domain Luk94
LPAPKNLVVSRVTEDSARLSWYRRFLLFIFFDSFLIQYQESEKVGEAIVLTVPGSERSYDLTGLKPGTEYTVSIYGVGEQWGEASDLSNPLSAIFTT

SEQ ID NO: 123 - protein, 93 aa, Artificial
  leukotoxin binding domain Luk95
LPAPKNLVVSRVTEDSARLSWQHSQYFVLFDSFLIQYQESEKVGEAIVLTVPGSERSYDLTGLKPGTEYTVSIYGVLYRQWRDSNPLSAIFTT

SEQ ID NO: 124 - protein, 95 aa, Artificial
  leukotoxin binding domain Luk96
LPAPKNLVVSRVTEDSARLSWTAPDAAFDSFLIQYQESEKVGEAIVLTVPGSERSYDLTGLKPGTEYTVSIYGVEHWPSWWHLNFSNPLSAIFTT

SEQ ID NO: 125 - protein, 96 aa, Artificial
  leukotoxin binding domain Luk97
LPAPKNLVVSRVTEDSARLSWTAPDAAFDSFLIQYQESEKVGEAIVLTVPGSERSYDLTGLKPGTEYTVSIYGVIDIIHINSWNDHSNPLSAIFTT

SEQ ID NO: 126 - protein, 93 aa, Artificial
  leukotoxin binding domain Luk98
LPAPKNLVVSRVTEDSARLSWNRHSHEFDSFLIQYQESEKVGEAIVLTVPGSERSYDLTGLKPGTEYTVSIYGVRIWVLKLNESNPLSAIFTT

SEQ ID NO: 127 - protein, 89 aa, Artificial
  leukotoxin binding domain Luk99
LPAPKNLVVSRVTEDSARLSWTAPDAAFDSFEIIYYERHDNGEAIVLTVPGSERSYDLTGLKPGTEYLVWIPGVKGGLTSWPLSAIFTT

SEQ ID NO: 128 - protein, 89 aa, Artificial
  leukotoxin binding domain Luk100
LPAPKNLVVSRVTEDSARLSWTAPDAAFDSFPITYGEYRSVGEAIVLTVPGSERSYDLTGLKPGTEYIVDIYGVKGGLFSYPLSAIFTT

SEQ ID NO: 129 - protein, 96 aa, Artificial
  leukotoxin binding domain Luk101
LPAPKNLVVSRVTEDSARLSWDTEPEWFDSFLIQYQESEKVGEAIVLTVPGSERSYDLTGLKPGTEYTVSIYGVQRVEIRALYRSYSNPLSAIFTT

SEQ ID NO: 130 - protein, 95 aa, Artificial
  leukotoxin binding domain Luk102
LPAPKNLVVSRVTEDSARLSWTAPDAAFDSFLIQYQESEKVGEAIVLTVPGSERSYDLTGLKPGTEYTVSIYGVSHRFWKHVYFYSNPLSAIFTT

SEQ ID NO: 131 - protein, 96 aa, Artificial
  leukotoxin binding domain Luk103
LPAPKNLVVSRVTEDSARLSWIIGLSRFDSFLIQYQESEKVGEAIVLTVPGSERSYDLTGLKPGTEYTVSIYGVDFAHQDFFRGYASNPLSAIFTT

SEQ ID NO: 132 - protein, 95 aa, Artificial
  leukotoxin binding domain Luk104
LPAPKNLVVSRVTEDSARLSWTAPDAAFDSFLIQYQESEKVGEAIVLTVPGSERSYDLTGLKPGTEYTVSIYGVQWWVVAFHHAPSNPLSAIFTT

SEQ ID NO: 133 - protein, 95 aa, Artificial
  leukotoxin binding domain Luk106
LPAPKNLVVSRVTEDSARLSWTAPDAAFDSFLIQYQESEKVGEAIVLTVPGSERSYDLTGLKPGTEYTVSIYGVVAWIFTKVLNASNPLSAIFTT

SEQ ID NO: 134 - protein, 95 aa, Artificial
  leukotoxin binding domain Luk107
LPAPKNLVVSRVTEDSARLSWKGPNSPPSQFDSFLIQYQESEKVGEAIVLTVPGSERSYDLTGLKPGTEYTVSIYGVWKWRTRAHSNPLSAIFTT

SEQ ID NO: 135 - protein, 96 aa, Artificial
  leukotoxin binding domain Luk108
LPAPKNLVVSRVTEDSARLSWFYYYLGKFGFDSFLIQYQESEKVGEAIVLTVPGSERSYDLTGLKPGTEYTVSIYGVVNWRWWPDDSNPLSAIFTT

SEQ ID NO: 136 - protein, 96 aa, Artificial
  leukotoxin binding domain Luk109
LPAPKNLVVSRVTEDSARLSWTAPDAAFDSFLIQYQESEKVGEAIVLTVPGSERSYDLTGLKPGTEYTVSIYGVIINRFWAWYLASSNPLSAIFTT

SEQ ID NO: 137 - protein, 96 aa, Artificial
  leukotoxin binding domain Luk110
LPAPKNLVVSRVTEDSARLSWTAPDAAFDSFLIQYQESEKVGEAIVLTVPGSERSYDLTGLKPGTEYTVSIYGVGFPTFLNYWQFGSNPLSAIFTT

SEQ ID NO: 138 - protein, 89 aa, Artificial
  leukotoxin binding domain Luk112
LPAPKNLVVSRVTEDSARLSWTAPDAAFDSFEIHYYEFRHHGEAIVLTVPGSERSYDLTGLKPGTEYAFWIYGVKGGGSSWPLSAIFTT

SEQ ID NO: 139 - protein, 89 aa, Artificial
  leukotoxin binding domain Luk113
LPAPKNLVVSRVTEDSARLSWTAPDAAFDSFWIEYHEEYETGEAIVLTVPGSERSYDLTGLKPGTEYWVWIAGVKGGKWSWPLSAIFTT

SEQ ID NO: 140 - protein, 89 aa, Artificial
  leukotoxin binding domain Luk114
LPAPKNLVVSRVTEDSARLSWTAPDAAFDSFEIHYQELPQKGEAIVLTVPGSERSYDLTGLKPGTEYVVWIWGVKGGLTSDPLSAIFTT

SEQ ID NO: 141 - protein, 89 aa, Artificial
  leukotoxin binding domain Luk116
LPAPKNLVVSRVTEDSARLSWTAPDAAFDSFEIHYQEYPAFGEAIVLTVPGSERSYDLTGLKPGTEYIVWIWGVKGGWTSWPLSAIFTT

SEQ ID NO: 142 - protein, 89 aa, Artificial
  leukotoxin binding domain Luk117
LPAPKNLVVSRVTEDSARLSWTAPDAAFDSFEIHYQETISVGEAIVLTVPGSERSYDLTGLKPGTEYWVLIWGVKGGAASDPLSAIFTT

SEQ ID NO: 143 - protein, 89 aa, Artificial
  leukotoxin binding domain Luk119
LPAPKNLVVSRVTEDSARLSWTAPDAAFDSFSIDYFEEYQKGEAIVLTVPGSERSYDLTGLKPGTEYWVWIFGVKGGIRSWPLSAIFTT

SEQ ID NO: 144 - protein, 89 aa, Artificial
  leukotoxin binding domain Luk120
LPAPKNLVVSRVTEDSARLSWTAPDAAFDSFEINYWEAYIHGEAIVLTVPGSERSYDLTGLKPGTEYWVWIHGVKGGGNSYPLSAIFTT

SEQ ID NO: 145 - protein, 89 aa, Artificial
  leukotoxin binding domain Luk122
LPAPKNLVVSRVTEDSARLSWTAPDAAFDSFEIHYYEFAIKGEAIVLTVPGSERSYDLTGLKPGTEYAVWIYGVKGGNSSWPLSAIFTT

SEQ ID NO: 146 - protein, 89 aa, Artificial
  leukotoxin binding domain Luk123
LPAPKNLVVSRVTEDSARLSWTAPDAAFDSFEIDYFEEYSHGEAIVLTVPGSERSYDLTGLKPGTEYWVWINGVKGGIYSYPLSAIFTT

SEQ ID NO: 147 - protein, 89 aa, Artificial
  leukotoxin binding domain Luk124
LPAPKNLVVSRVTEDSARLSWTAPDAAFDSFTIDYVESYALGEAIVLTVPGSERSYDLTGLKPGTEYWVWIWGVKGGSLSYPMSAIFTT

SEQ ID NO: 148 - protein, 89 aa, Artificial
  leukotoxin binding domain Luk125
LPAPKNLVVSRVTEDSARLSWTAPDAAFDSFPIIYYEHHNFGEAIVLTVPGSERSYDLTGLKPGTEYAVPIPGVKGGWQSLPLSAIFTT

SEQ ID NO: 149 - protein, 89 aa, Artificial
  leukotoxin binding domain Luk126
LPAPKNLVVSRVTEDSARLSWTAPDAAFDSFYIDYQEWPSVGEAIVLTVPGSERSYDLTGLKPGTEYSVFIHGVKGGWLSKPLSAIFTT

SEQ ID NO: 150 - protein, 89 aa, Artificial
  leukotoxin binding domain Luk128
LPAPKNLVVSRVTEDSARLSWTAPDAAFDSFDIQYFEEYAIGEAIVLTVPGSERSYDLTGLKPGTEYWVWISGVKGGNFSKPLSAIFTT

SEQ ID NO: 151 - protein, 89 aa, Artificial
  leukotoxin binding domain Luk129
LPAPKNLVVSRVTEDSARLSWTAPDAAFDSFNINYPEEFHGGEAIVLTVPGSERSYDLTGLKPGTEYEVWIWGVKGGSSSNPLSAIFTT

SEQ ID NO: 152 - protein, 89 aa, Artificial
  leukotoxin binding domain Luk130
LPAPKNLVVSRVTEDSARLSWTAPDAAFDSFNIHYLEWEVNGEAIVLTVPGSERSYDLTGLKPGTEYIVEIWGVKGGYSSWPLSAIFTT

SEQ ID NO: 153 - protein, 89 aa, Artificial
  leukotoxin binding domain Luk132
LPAPKNLVVSRVTEDSARLSWTAPDAAFDSFYIEYWEWDPVGEAIVLTVPGSERSYDLTGLKPGTEYPVFISGVKGGYPSVPLSAIFTT

SEQ ID NO: 154 - protein, 89 aa, Artificial
  leukotoxin binding domain Luk133
LPAPKNLVVSRVTEDSARLSWTAPDAAFDSFIIHYGEGPEFGEAIVLTVPGSERSYDLTGLKPGTEYSVHIPGVKGGWLSWPLSAIFTT

SEQ ID NO: 155 - protein, 89 aa, Artificial
  leukotoxin binding domain Luk134
LPAPKNLVVSRVTEDSARLSWTAPDAAFDSFTIVYLEWVVLGEAIVLTVPGSERSYDLTGLKPGTEYIVDIYGVKGGWTSRPLSAIFTT

SEQ ID NO: 156 - protein, 89 aa, Artificial
  leukotoxin binding domain Luk136
LPAPKNLVVSRVTEDSARLSWTAPDAAFDSFTIDYFEEYVVGEAIVLTVPGSERSYDLTGLKPGTEYWVCIVGVKGGTPSPPLSAIFTT

SEQ ID NO: 157 - protein, 89 aa, Artificial
  leukotoxin binding domain Luk138
LPAPKNLVVSRVTEDSARLSWTAPDAAFDSFHIWYQEFEVRGEAIVLTVPGSERSYDLTGLKPGTEYDVEIWGVKGGSHSWTLSAIFTT

SEQ ID NO: 158 - protein, 89 aa, Artificial
  leukotoxin binding domain Luk139
LPAPKNLVVSRVTEDSARLSWTAPDAAFNSFEIHYGEWEYGGEAIVLTVPGSERSYDLTGLKPGTEYTVWIYGVKGGDSSWPLSAIFTT

SEQ ID NO: 159 - protein, 89 aa, Artificial
  leukotoxin binding domain Luk140
LPAPKNLVVSRVTEDSARLSWTAPDAAFDSFEIHYQETKKSGEAIVLTVPGSERSYDLTGLKPGTEYWVLIWGVKGGTASNPLSAIFTT

SEQ ID NO: 160 - protein, 89 aa, Artificial
  leukotoxin binding domain Luk143
LPAPKNLVVSRVTEDSARLSWTAPDAAFDSFDIQYDERTEEGEAIVLTVPGSERSYDLTGLKPGTEYFVTIPGVKGGWYSWPLSAIFTT

SEQ ID NO: 161 - protein, 89 aa, Artificial
  leukotoxin binding domain Luk144
LPAPKNLVVSRVTEDSARLSWTAPDAAFDSFWIDYFEEWVNGEAIVLTVPGSERSYDLTGLKPGTEYWVWIQGVKGGVHSPPLSAIFTT

SEQ ID NO: 162 - protein, 89 aa, Artificial
  leukotoxin binding domain Luk148
LPAPKNLVVSRVTEDSARLSWTAPDAAFDSFEIHYQELNRVGEAIVLTVPGSERSYDLTGLKPGTEYWVLIWGVKGGDSSEPLSAIFTT

SEQ ID NO: 163 - protein, 89 aa, Artificial
  leukotoxin binding domain Luk151
LPAPKNLVVSRVTEDSARLSWTAPDAAFDSFGITYTEVYWWGEAIVLTVPGSERSYDLTGLKPGTEYTVTIPGVKGGWISAPLSAIFTT

SEQ ID NO: 164 - protein, 89 aa, Artificial
  leukotoxin binding domain Luk155
LPAPKNLVVSRVTEDSARLSWTAPDAAFDSFSIRYFEFIKPGEAIWLGVPGSERSYDLTGLKPGTEYHVQIRGVKGGRESYPLWADFTT

SEQ ID NO: 165 - protein, 89 aa, Artificial
  leukotoxin binding domain Luk156
LPAPKNLVVSRVTEDSARLSWTAPDAAFDSFEIQYHETRYSGEAIWLWVPGSERSYDLTGLKPGTEYSVYIPGVKGGNVSFPLKAHFTT

SEQ ID NO: 166 - protein, 89 aa, Artificial
  leukotoxin binding domain Luk158
LPAPKNLVVSRVTEDSARLSWTAPDAAFDSFAISYKESGRIGEAISLIVPGSERSYDLTGLKPGTEYWVYINGVKGGITSFPLNAWFTT

SEQ ID NO: 167 - protein, 89 aa, Artificial
  leukotoxin binding domain Luk159
LPAPKNLVVSRVTEDSARLSWTAPDAAFDSFGIDYKETGYTGEAIELEVPGSEHSYDLTGLKPGTEYFVTIGGVKGGYSSWPLVALFTT

SEQ ID NO: 168 - protein, 89 aa, Artificial
  leukotoxin binding domain Luk160
LPAPKNLVVSRVTEDSARLSWTAPDAAFDSFVIWYTENPSLGEAIKLSVPGSERSYDLTGLKPGTEYVVEIWGVKGGRGSVPLFAIFTT

SEQ ID NO: 169 - protein, 89 aa, Artificial
  leukotoxin binding domain Luk163
LPAPKNLVVSRVTEDSARLSWTAPDAAFDSFYIEYWEPTSDGEAIALNVPGSERSYDLTGLKPGTEYFVEIWGVKGGPRSPPLSAWFTT

SEQ ID NO: 170 - protein, 89 aa, Artificial
  leukotoxin binding domain Luk164
LPAPKNLVVSRVTEDSARLSWTAPDAAFDSFDIEYGEPEKIGEAIWLTVPGSERSYDLTGLKPGTEYWVFIYGVKGGALSRPLTATSTT

SEQ ID NO: 171 - protein, 89 aa, Artificial
  leukotoxin binding domain Luk166
LPAPKNLVVSRVTEDSARLSWTAPDAAFDSFWIQYFEIQPWGEAILLDVPGSERSYDLTGLKPGTEYSVIIWGVKGGPKSQPLYAWFTT

SEQ ID NO: 172 - protein, 89 aa, Artificial
  leukotoxin binding domain Luk167
LPAPKNLVVSRVTEDSARLSWTAPDAAFDSFVIIYSEDTIPGEAIVLWVPGSERSYDLTGLKPGTEYYVQIEGVKGGHESFPLVANFTT

SEQ ID NO: 173 - protein, 89 aa, Artificial
  leukotoxin binding domain Luk174
LPAPKNLVVSRVTEDSARLSWTAPDAAFDSFDIEYGEPEKIGEAIWLTVPGSERSYDLTGLKPGTEYWVFIYGVKGGALSRPLTATFTT

SEQ ID NO: 174 - protein, 89 aa, Artificial
  leukotoxin binding domain Luk176
LPAPKNLVVSRVTEDSARLSWTAPDAAFDSFVIYYHEFPYGGEAIVLTVPGSERSYDLTGLKPGTEYYVRILGVKGGGLSYPLSAIFTT

SEQ ID NO: 175 - protein, 87 aa, Artificial
  leukotoxin binding domain Luk177
LPAPKNLVVSRVTEDSARLSWTAPDAAFDSFAIYYREWGSGEAIVLTVPGSERSYDLTGLKPGTEYLVITGVKGGNPSYPLSAIFTT

SEQ ID NO: 176 - protein, 89 aa, Artificial
  leukotoxin binding domain Luk178
LPAPKNLVVSRVTEDSARLSWTAPDAAFDSFAIHYFEAYAGGEAIVLTVPGSERSYDLTGLKPGTEYWVWIFGVKGGLYSYPLSAIFTT

SEQ ID NO: 177 - protein, 89 aa, Artificial
  leukotoxin binding domain Luk179
LPAPKNLVVSRVTEDSARLSWTAPDAAFDSFEINYFEAWDGGEAIVLTVPGSERSYDLTGLKPGTEYWVWISGVKGGRYSYPLSAIFTT

SEQ ID NO: 178 - protein, 89 aa, Artificial
  leukotoxin binding domain Luk180
LPAPKNLVVSRVTEDSARLSWTAPDAAFDSFEIHYYEPIYVGEAIVLTVPGSERSYDLTGLKPGTEYIVWIYGVKGGYSSWPLSAIFTT

SEQ ID NO: 179 - protein, 89 aa, Artificial
  leukotoxin binding domain Luk182
LPAPKNLVVSRVTEDSARLSWTAPDAAFDSFYILYIENDWQGEAIVLTVPGSERSYDLTGLKPGTEYFVVIHGVKGGWISPPLSAIFTT

SEQ ID NO: 180 - protein, 89 aa, Artificial
  leukotoxin binding domain Luk183
LPAPKNLVVSRVTEDSARLSWTAPDAAFDSFTIWYWEFLHNGEAIVLTVPGSERSYDLTGLKPGTEYFVEIYGVKGGSVSVPLSAIFTT

SEQ ID NO: 181 - protein, 89 aa, Artificial
  leukotoxin binding domain Luk184
LPAPKNLVVSRVTEDSARLSWTAPDAAFDSFTIIYHELNTAGEAIVLTVPGSERSYDLTGLKPGTEYLVIIHGVKGGPISSPLSAIFTT

SEQ ID NO: 182 - protein, 89 aa, Artificial
  leukotoxin binding domain Luk185
LPAPKNLVVSRVTEDSARLSWTAPDAAFDSFRIVYREWFHYGEAIVLTVPGSERSYDLTGLKPGTEYYVVIHGVKGGYISKPLSAIFTT

SEQ ID NO: 183 - protein, 89 aa, Artificial
  leukotoxin binding domain Luk186
LPAPKNLVVSRVTEDSARLSWTAPDAAFDSFHITYTEYSFVGEAIVLTVPGSERSYDLTGLKPGTEYFVEIYGVKGGFISSPLSAIFTT

SEQ ID NO: 184 - protein, 89 aa, Artificial
  leukotoxin binding domain Luk187
LPAPKNLVVSRVTEDSARLSWTAPDAAFDSFRILYFEYKRLGEAIVLTVPGSERSYDLTGLKPGTEYFVGIHGVKGGYISRPLSAIFTT

SEQ ID NO: 185 - protein, 89 aa, Artificial
  leukotoxin binding domain Luk188
LPAPKNLVVSRVTEDSARLSWTAPDAAFDSFHIHYWEFNPAGEAIVLTVPGSERSYDLTGLKPGTEYFVGIHGVKGGGISWPLSAIFTT

SEQ ID NO: 186 - protein, 89 aa, Artificial
  leukotoxin binding domain Luk189
LPAPKNLVVSRVTEDSARLSWTAPDAAFDSLKIFYFEFIYLGEAIVLTVPGSERSYDLTGLKPGTEYHVTIHGVKGGTISLPLSAIFTT

SEQ ID NO: 187 - protein, 89 aa, Artificial
  leukotoxin binding domain Luk190
LPAPKNLVVSRVTEDSARLSWTAPDAAFDSFHIFYYEFSNYGEAIVLTVPGSERSYDLTGLKPGTEYFVIIHGVKGGQISVPLSAIFTT

SEQ ID NO: 188 - protein, 88 aa, Artificial
  leukotoxin binding domain Luk191
LPAPKNLVVSRVTEDSARLSWTAPDAAFDSFTIFYWEWYHGEAIVLTVPGSERSYDLTGLKPGTEYNVVIHGVKGGYISLPLSAIFTT

SEQ ID NO: 189 - protein, 89 aa, Artificial
  leukotoxin binding domain Luk192
LPAPKNLDVSRVTEDSARLSWTAPDAAFDSFVIFYYEEKPIGEAIVLTVPGSERSYDLTGLKPGTEYFVEIYGVKGGYISNPLSAIFTT

SEQ ID NO: 190 - protein, 89 aa, Artificial
  leukotoxin binding domain Luk193
LPAPKNLVVSRVTEDSARLSWTAPDAAFDSFNIFYHETRPLGEAIVLTVPGSERSYDLTGLKPGTEYLVAIYGVKGGYISLPLSAIFTT

SEQ ID NO: 191 - protein, 89 aa, Artificial
  leukotoxin binding domain Luk194
LPAPKNLVVSRVTEDSARLSWTAPDAAFDSFTIHYWEFSDNGEAIVLTVPGSERSYDLTGLKPGTEYLVGIYGVKGGQISQPLSAIFTT

SEQ ID NO: 192 - protein, 89 aa, Artificial
  leukotoxin binding domain Luk195
LPAPKNLVVSRVTEDSARLSWTAPDAAFDSFHIIYYEYPAGGEAIVLTVPGSERSYDLTGLKPGTEYHVIIHGVKGGFVSVPLSAIFTT

SEQ ID NO: 193 - protein, 89 aa, Artificial
  leukotoxin binding domain Luk196
LPAPKNLVVSRVTEDSARLSWTAPDAAFDSFNIIYIENPYWGEAIVLTVPGSERSYDLTGLKPGTEYFVIIHGVKGGYISEPLSAIFTT

SEQ ID NO: 194 - protein, 89 aa, Artificial
  leukotoxin binding domain Luk197
LPAPKNLVVSRVTEDSARLSWTAPDAAFDSFTILYWEVQANGEAIVLTVPGSERSYDLTGLKPGTEYVVGIYGVKGGYISLPLSAIFTT

SEQ ID NO: 195 - protein, 89 aa, Artificial
  leukotoxin binding domain Luk198
LPAPKNLVVSRVTEDSARLSWTAPDAAFDSFQIFYTEEKTWGEAIVLTVPGSERSYDLTGLKPGTEYFVWIHGVKGGWISAPLSAIFTT

SEQ ID NO: 196 - protein, 89 aa, Artificial
  leukotoxin binding domain Luk199
LPAPKNLVVSRVTEDSARLSWTAPDAAFDSFTILYAEHSNKGEAIVLTVPGSERSYDLTGLKPGTEYFVGIYGVKGGFISWPLSAIFTT

SEQ ID NO: 197 - protein, 89 aa, Artificial
  leukotoxin binding domain Luk201
LPAPKNLVVSRVTEDSARLSWTAPDAAFDSFTIFYLEHNDEGEAIVLTVPGSERSYDLTGLKPGTEYWVAIHGVKGGYISQPLSAIFTT

SEQ ID NO: 198 - protein, 88 aa, Artificial
  leukotoxin binding domain Luk202
LPAPKNLVVSRVTEDSARLSWTAPDAAFDSFRIWYHETWRGEAIVLTVPGSERSYDLTGLKPGTEYPVVIHGVKGGFISTPLSAIFTT

SEQ ID NO: 199 - protein, 89 aa, Artificial
  leukotoxin binding domain Luk203
LPAPKNLVVSRVTEDSARLSWTAPDAAFDSFTIIYVEYETWGEAIVLTVPGSERSYDLTGLKPGTEYIVAIHGVKGGYISIPLSAIFTT

SEQ ID NO: 200 - protein, 89 aa, Artificial
  leukotoxin binding domain Luk204
LPAPKNLVVSRVTEDSARLSWTAPDAAFDSFPIIYWELWSIGEAIVLTVPGSERSYDLTGLKPGTEYFVEIYGVKGGTISTPLSAIFTT

SEQ ID NO: 201 - protein, 89 aa, Artificial
  leukotoxin binding domain Luk205
LPAPKNLVVSRVTEDSARLSWTAPDAAFDSFSILYWEWVANGEAIVLTVPGSERSYDLTGLKPGTEYFVEIYGVKGGWLSLPLSAIFTT

SEQ ID NO: 202 - protein, 89 aa, Artificial
  leukotoxin binding domain Luk206
LPAPKNLVVSRVTEDSARLSWTAPDAAFDSFAIFYFEQFSRGEAIVLTVPGSERSYDLTGLKPGTEYFVAIHGVKGGFVSRPLSAIFTT

SEQ ID NO: 203 - protein, 89 aa, Artificial
  leukotoxin binding domain Luk208
LPAPKNLVVSRVTEDSARLSWTAPDAAFDSFTIWYWEWYHLGEAIVLTVPGSELSYDLTGLKPGTEYWVEIYGVKGGFISQPLSAIFTT

SEQ ID NO: 204 - protein, 89 aa, Artificial
  leukotoxin binding domain Luk210
LPAPKNLVVSRVTEDSARLSWTAPDAAFDSFPIFYFEYLGNGEAIVLTVPGSERSYDLTGLKPGTEYFVGIHGVKGGVISTPLSAIFTT

SEQ ID NO: 205 - protein, 89 aa, Artificial
  leukotoxin binding domain Luk211
LPAPKNLVVSRVTEDSARLSWTAPDAAFDSFTIIYFEWKRLGEAIVPTVPGSERSYDLTGLKPGTEYWVGIYGVKGGPISVPLSAIFTT

SEQ ID NO: 206 - protein, 89 aa, Artificial
  leukotoxin binding domain Luk212
LPAPKNLVVSRVTEDSARLSWTAPDAAFDSFTILYTEREFYGEAIVLTVPGSERSYDLTGLKPGTEYWVGIYGVKGGNISEPLSAIFTT

SEQ ID NO: 207 - protein, 89 aa, Artificial
  leukotoxin binding domain Luk213
LPAPKNLVVSRVTEDSARLSWTAPDAAFDSFHIFYHETDAYGEAIVLTVPGSERSYDLTGLKPGTEYFVVIHGVKGGFISSPLSAIFTT

SEQ ID NO: 208 - protein, 89 aa, Artificial
  leukotoxin binding domain Luk214
LPAPKNLVVSRVTEDSARLSWTAPDAAFDSFAIHYWEYDANGEAIVLTVPGSERSYDLTGLKPGTEYLVAIYGVKGGLISVPLSAIFTT

SEQ ID NO: 209 - protein, 89 aa, Artificial
  leukotoxin binding domain Luk215
LPAPKNLVVSRVTEDSARLSWTAPDAAFDSFTILYHESVTNGEAIVLTVPGSERSYDLTGLKPGTEYLVGIYGVKGGYISDPLSAIFTT

SEQ ID NO: 210 - protein, 89 aa, Artificial
  leukotoxin binding domain Luk216
LPAPKNLVVSRVTEDSARLSWTAPDAAFDSFRIHYFEESITGEAIVLTVPGSERSYDLTGLKPGTEYFVAIYGVKGGSISDPLSAIFTT

SEQ ID NO: 211 - protein, 89 aa, Artificial
  leukotoxin binding domain Luk218
LPAPKNLVVSRVTEDSARLSWTAPDAAFDSFSIIYWEYRWQGEAIVLTVPGSERSYDLTGLKPGTEYIVPIHGVKGGEISPPLSAIFTT

SEQ ID NO: 212 - protein, 89 aa, Artificial
  leukotoxin binding domain Luk219
LPAPKNLVVSRVTEDSARLSWTAPDAAFDSFTIWYWVYRTSGEAIVLTVPGSERSYDLTGLKPGTEYFVAIHGVKGGEISVPLSAIFTT

SEQ ID NO: 213 - protein, 89 aa, Artificial
  leukotoxin binding domain Luk220
LPAPKNLVVSRVTEDSARLSWTAPDAAFDSFAIFYWEESPPGEAIVLTVPGSERSYDLTGLKPGTEYLVAIYGVKGGYISLPLSAIFTT

SEQ ID NO: 214 - protein, 89 aa, Artificial
  leukotoxin binding domain Luk221
LPAPKNLVVSRVTEDSARLSWTAPDAAFDSFAIFYHELEHHGEAIVLTVPGSERSYDLTGLKPGTEYFVAIHGVKGGQISWPLSAIFTT

SEQ ID NO: 215 - protein, 88 aa, Artificial
  leukotoxin binding domain Luk222
LPAPKNLVVSRVTEDSARLSWTAPDAAFDSFSILYWEEEFGEAIVLTVPGSERSYDLTGLKPGTEYFVAIHGVKGGYISRPLSAIFTT

SEQ ID NO: 216 - protein, 89 aa, Artificial
  leukotoxin binding domain Luk223
LPAPKNLVVSRVTEDSARLSWTAPDAAFDSFVILYWEEENQGEAIVLTVPGSERSYDLTGLKPGTEYFVAIHGVKGGHISEPLSAIFTT

SEQ ID NO: 217 - protein, 89 aa, Artificial
  leukotoxin binding domain Luk224
LPAPKNLVVSRVTEDSARLSWTAPDAAFDSFTIFYTEHGVSGEAIVLTVPGSERSYDLTGLKPGTEYWVPIHGVKGGTISQPLSAIFTT

SEQ ID NO: 218 - protein, 89 aa, Artificial
  leukotoxin binding domain Luk225
LPAPKNLVVSRVTEDSARLSWTAPDAAFDSFQIFYHEFLTIGEAIVLTVPGSERSYDLTGLKPGTEYIVAIYGVKGGQISDPLSAIFTT

SEQ ID NO: 219 - protein, 89 aa, Artificial
  leukotoxin binding domain Luk226
LPAPKNLVVSRVTEDSARLSWTAPDAAFDSFTIHYAEWHLDGEAIVLTVPGSERSYDLTGLKPGTEYFVAIHGVKGGYISEPLSAIFTT

SEQ ID NO: 220 - protein, 89 aa, Artificial
  leukotoxin binding domain Luk227
LPAPKNLVVSRVTEDSARLSWTAPDAAFDSFRIYYHEWQATGEAIVLTVPGSERSYDLTGLKPGTEYLVVIHGVKGGWISSPLSAIFTT

SEQ ID NO: 221 - protein, 89 aa, Artificial
  leukotoxin binding domain Luk228
LPAPKNLVVSRVTEDSARLSWTAPDAAFDSFTIPYYEYAVFGEATVLTVPGSERSYDLTGLKPGTEYHVIIHGVKGGYISLPLSAIFTT

SEQ ID NO: 222 - protein, 89 aa, Artificial
  leukotoxin binding domain Luk229
LPAPKNLVVSRVTEDSARLSWTAPDAAFDSFYIFYLEWNQIGEAIVLTVPGSERSYDLTGLKPGTEYFVAIYGVKGGFISDPLSAIFTT

SEQ ID NO: 223 - protein, 89 aa, Artificial
  leukotoxin binding domain Luk230
LPAPKNLVVSRVTEDSARLSWTAPDAAFDSFIIFYTESHFYGEAIVLTVPGSERSYDLTGLKPGTEYWVAIYGVKGGEFSFPLSAIFTT

SEQ ID NO: 224 - protein, 89 aa, Artificial
  leukotoxin binding domain Luk231
LPAPKNLVVSRVTEDSARLSWTAPDAAFDSFRILYWEYVTAGEAIVLTVPGSERSYDLTGLKPGTEYFVVIHGVKGGYISIPLSAIFTT

SEQ ID NO: 225 - protein, 89 aa, Artificial
  leukotoxin binding domain Luk233
LPAPKNLVVSRVTEDSACLSWTAPDAAFDSFAIQYWEYSGIGEAIVLTVPGSERSYGLTGLKPGTEYFVGIAGVKGGWISLPLSAIFTT

SEQ ID NO: 226 - protein, 89 aa, Artificial
  leukotoxin binding domain Luk235
LPAPKNLVVSRVTEDSARLSWTAPDAAFDSFSIIYHEWDKNGEAIVLTVPGSERSYDLTGLKPGTEYFVAIYGVKGGYISRPLSAIFTT

SEQ ID NO: 227 - protein, 89 aa, Artificial
  leukotoxin binding domain Luk236
LPAPKNLVVSRVTEDSARLSWTAPDAAFDSFNIFYWEYILPGEAIVLTVPGSERSYDLTGLKPGTEYWVIIHGVKGGHISDPLSAIFTT

SEQ ID NO: 228 - protein, 90 aa, Artificial
  leukotoxin binding domain Luk237
MLPPPKNLVVSRVTEDSARLSWTAPDAAFDSFQIIYWEYAETGEAIVLTVPGSERSYDLTGLKPGTEYIVIIHGVKGGEISRPLSAIFTT

SEQ ID NO: 229 - protein, 89 aa, Artificial
  leukotoxin binding domain Luk238
LPAPKNLVVSRVTEDSARLSWTAPDAAFDSFAIFYHETVKSGEAIVLTVPGSERSYDLTGLKPGTEYFVVIHGVKRGQISEPLSAIFTT

SEQ ID NO: 230 - protein, 89 aa, Artificial
  leukotoxin binding domain Luk239
LPAPKNLVVSRVTEDSARLSWTAPDAAFDSFHISYWEYAVYGEAIVLTVPGSERSYDLTGLKPGTEYFVGIYGVKGGWISSPLSAIFTT

SEQ ID NO: 231 - protein, 89 aa, Artificial
  leukotoxin binding domain Luk240
LPAPKNLVVSRVTEDSARLSWTAPDAAFDSFPIFYDEEAHNGEAIVLTVPGSERSYDLTGLKPGTEYFVVIHGVKGGTISIPLSAIFTT

SEQ ID NO: 232 - protein, 89 aa, Artificial
  leukotoxin binding domain Luk241
LPAPKNLVVSRVTEDSARLSWTAPDAAFDSFTIYYFESYAVGEAIVLTVPGSERSYDLTGLKPGTEYFVAIYGVKGGWISWPLSAIFTT

SEQ ID NO: 233 - protein, 89 aa, Artificial
  leukotoxin binding domain Luk242
LPAPKNLVVSRVTEDSARLSWTAPDAAFDSFVIFYHETEVDGEAIVLTVPGSERSYDLTGLKPGTEYVVIIHGVKGGFISYPLSAIFTT

SEQ ID NO: 234 - protein, 89 aa, Artificial
  leukotoxin binding domain Luk243
LPAPKNLVVSRVTEDSARLSWTAPDAAFDSFQIMYFEFQALGEAIVLTVPGSERSYDLTGLKPGTEYLVLIHGVKGGLISPPLSAIFTT

SEQ ID NO: 235 - protein, 89 aa, Artificial
  leukotoxin binding domain Luk244
LPAPKNLVVSRVTEDSARLSWTAPDAAFDSFNIYYWEFLENGEAIVLTVPGSERSYDLTGLKPGTEYFVAIHGVKGGFISWPLSAIFTT

SEQ ID NO: 236 - protein, 89 aa, Artificial
  leukotoxin binding domain Luk245
LPAPKNLVVSRVTEDSARLSWTAPDAAFDSFTIHYWEFRPGGEAIVLTVPGSERSYDLTGLKPGTEYFVAIFGVKGGSISVPLSAIFTT

SEQ ID NO: 237 - protein, 89 aa, Artificial
  leukotoxin binding domain Luk246
LPAPKNLVVSRVTEDSARLSWTAPDAAFDSFVIHYFEASPPGEAIVLTVPGSERSYDLTGLKPGTEYYVVIYGVKGGYISPPLSAIFTT

SEQ ID NO: 238 - protein, 89 aa, Artificial
  leukotoxin binding domain Luk247
LPAPKNLVVSRVTEDSARLSWTAPDAAFDSFTIFYHEYVQVGEAIVLTVPGSERSYDLTGLKPGTEYFVAIYGVKGGQISDPLSAIFTT

SEQ ID NO: 239 - protein, 89 aa, Artificial
  leukotoxin binding domain Luk248
LPAPKNLVVSRVTEDSARLSWTAPDAAFDSFNIIYWEYVDVGEAIVLTVPGSERSYDLTGLKPGTEYLVPIYGVKGGLISEPLSAIFTT

SEQ ID NO: 240 - protein, 89 aa, Artificial
  leukotoxin binding domain Luk249
LPAPKNLVVSRVTEDSARLSWTAPDAAFDSFAIVYWEQKFYGEAIVLTVPGSERSYDLTGLKPGTEYFVGIYGVKGGFISLPLSAIFTT

SEQ ID NO: 241 - protein, 89 aa, Artificial
  leukotoxin binding domain Luk250
LPAPKNLVVSRVTEDSARLSWTAPDAAFDSFVIFYDEWRGVGEAIVLTVPGSERSYDLTGLKPGTEYFVPIQGVKGGYVSDPLSAIFTT

SEQ ID NO: 242 - protein, 89 aa, Artificial
  leukotoxin binding domain Luk251
LPAPKNLVVSRVTEDSARLSWTAPDAAFDSFAIHYHEYQQIGEAIVLTVPGSERSYDLIGLKPGTEYFVAIYGVKGGFISQPLSAIFTT

SEQ ID NO: 243 - protein, 89 aa, Artificial
  leukotoxin binding domain Luk252
LPAPKNLVVSRVTEDSARLSWTAPDAAFDSFAIFYLEWPAKGEAIVLTVPGSERSYDLTGLKPGTEYFVVIHGVKGGWISPPLSAIFTT

SEQ ID NO: 244 - protein, 89 aa, Artificial
  leukotoxin binding domain Luk253
LPAPKNLVVSRVTEDSARLSWTAPDAAFDSFNIVYWEYNPVGEAIVLTVPGSERSYDLTGLKPGTEYFVGIYGVKGGNISKPLSAIFTT

SEQ ID NO: 245 - protein, 89 aa, Artificial
  leukotoxin binding domain Luk254
LPAPKNLVVSRVTEDSARLSWTAPDAAFDSFGIFYLEHDWRGEAIVLTVPGSERSYDLTGLKPGTEYLVIIHGVKGGSISVPLSAIFTT

SEQ ID NO: 246 - protein, 89 aa, Artificial
  leukotoxin binding domain Luk255
LPAPKNLVVSRVTEDSARLSWTAPDAAFDSFTILYWEYEQQGEAIVLTVPGSERSYDLTGLKPGTEYFVAIHGVKGGEISQPLSAIFTT

SEQ ID NO: 247 - protein, 89 aa, Artificial
  leukotoxin binding domain Luk257
LPAPKNLVVSRVTEDSARLSWTAPDAAFDSFTIIYIEHVDWGEAIVLTVPGSERSYDLTGLKPGTEYFVEIYGVKGGKISAPLSAIFTT

SEQ ID NO: 248 - protein, 89 aa, Artificial
  leukotoxin binding domain Luk258
LPAPKNLVVSRVTEDSARLSWTAPDAAFDSFTIYYFESVDWGEAIVLTVPGSERSYDLTGLKPGTEYYVYIYGVKGGWISVPLSAIFTT

SEQ ID NO: 249 - protein, 89 aa, Artificial
  leukotoxin binding domain Luk259
LPAPKNLVVSRVTEDSARLSWTAPDAAFDSFQIIYWESQYWGEAIVLTVPGSERSYDLTGLKPGTEYIVVIHGVKGGGISDPLSAIFTT

SEQ ID NO: 250 - protein, 89 aa, Artificial
  leukotoxin binding domain Luk260
LPAPKNLVVSRVTEDSARLSWTAPDAAFDSFRIIYYEWESAGEAIVLTVPGSERSYDLTGLKPGTEYFVAIHGVKGGFISFPLSAIFTT

SEQ ID NO: 251 - protein, 89 aa, Artificial
  leukotoxin binding domain Luk261
LPAPKNLVVSRVTEDSARLSWTAPDAAFDSFNIFYWEFQKKGEAIVLTVPGSERSYDLTGLKPGTEYIVIIYGVKGGFISPPLSAIFTT

SEQ ID NO: 252 - protein, 89 aa, Artificial
  leukotoxin binding domain Luk262
LPAPKNLVVSRVTEDSARLSWTAPDAAFDSFHIFYLEKTNYGEAIVLTVPGSERSYDLTGLKPGTEYLVIIHGVKGGPISGPLSAIFTT

SEQ ID NO: 253 - protein, 89 aa, Artificial
  leukotoxin binding domain Luk263
LPAPKNLVVSRVTEDSARLSWTAPDAAFDSFGIWYWEYVRNGEAIVLTVPGSERSYDLTGLKPGTEYFVPIYGVKGGDTSPPLSAIFTT

SEQ ID NO: 254 - protein, 89 aa, Artificial
  leukotoxin binding domain Luk264
LPAPKNLVVSRVTEDSARLSWTAPDAAFDSFVIFYHEYFTVGEAIVLTVPGSERSYDLTGLKPGTEYFVAIHGVKGGLISAPLSAIFTT

SEQ ID NO: 255 - protein, 89 aa, Artificial
  leukotoxin binding domain Luk265
LPAPKNLVVSRVTEDSARLSWTAPDAAFDSFQIIYFENEYGGEAIVLTVPGSERSYDLTGLKPGTEYFVAIYGVKGGYLSVPLSAIFTT

SEQ ID NO: 256 - protein, 89 aa, Artificial
  leukotoxin binding domain Luk266
LPAPKNLVVSRVTEDSARLSWTAPDAAFDSFRIGYLENPWDGEAIVLTVPGSERSYDLTGLKPGTEYFVFIYGVKGGHISNPLSAIFTT

SEQ ID NO: 257 - protein, 89 aa, Artificial
  leukotoxin binding domain Luk267
LPAPKNLVVSRVTEDSARLSWTAPDAAFDSFIIHYFEYEPPGEAIVLTVPGSERSYDLTGLKPGTEYFVGIYGVKGGWVSEPLSAIFTT

SEQ ID NO: 258 - protein, 89 aa, Artificial
  leukotoxin binding domain Luk268
LPAPKNLVVSRVTEDSARLSWTAPDAAFDSFTIFYPEYSARGEAIVLTVPGSERSYDLTGLKPGTEYFVVIHGVKGGFVSEPLSAIFTT

SEQ ID NO: 259 - protein, 89 aa, Artificial
  leukotoxin binding domain Luk269
LPAPKNLVVSRVTEDSARLSWTAPDAAFDSFNIIYWEYEVAGEAIVLTVPGSERSYDLTGLKPGTEYFVSIQGVKGGAISPPLSAIFTT

SEQ ID NO: 260 - protein, 89 aa, Artificial
  leukotoxin binding domain Luk270
LPAPKNLVVSRVTEDSARLSWTAPDAAFDSFQIVYFEHPSYGEAIVLTVPGSERSYDLTGLKPGTEYFVGIYGVKGGEISAPLSAIFTT

SEQ ID NO: 261 - protein, 89 aa, Artificial
  leukotoxin binding domain Luk271
LPAPKNLVVSRVTEDSARLSWTAPDAAFDSFNIVYFEWAANGEAIVLTVPGSERSYDLTGLKPGTEYFVGIYGVKGGAISLPLSAIFTT

SEQ ID NO: 262 - protein, 89 aa, Artificial
  leukotoxin binding domain Luk272
LPAPKNLVVSRVTEDSARLSWTAPDAAFDSFNIFYWEDTLKGEAIVLTVPGSERSYDLTGLKPGTEYVVAIHGVKGGTISHPLSAIFTT

SEQ ID NO: 263 - protein, 89 aa, Artificial
  leukotoxin binding domain Luk273
LPAPKNLVVSRVTEDSARLSWTAPDAAFDSFVINYWEFQPAGEAIVLTVPGSERSYDLTGLKPGTEYFVAIHGVKGGQISKPLSAIFTT

SEQ ID NO: 264 - protein, 89 aa, Artificial
  leukotoxin binding domain Luk274
LPAPKNLVVSRVTEDSARLSWTAPDAAFDSFTIIYWELVWNGEAIVLTVPGSERSYDLTGLKPGTEYCVPIHGVKGGLISPPLSAIFTT

SEQ ID NO: 265 - protein, 89 aa, Artificial
  leukotoxin binding domain Luk275
LPAPKNLVVSRVTEDSARLSWTAPDAAFDSFVIFYEEWQVGGEAIVLTVPGSERSYDLTGLKPGTEYFVAIYGVKGGAISQPLSAIFTT

SEQ ID NO: 266 - protein, 89 aa, Artificial
  leukotoxin binding domain Luk276
LPAPKNLVVSRVTEDSARLSWTAPDAAFDSFYIHYFEYEIRGEAIVLTVPGSERSYDLTGLKPGTEYFVSIYGVKGGLISSPLSAIFTT

SEQ ID NO: 267 - protein, 89 aa, Artificial
  leukotoxin binding domain Luk277
LPAPKNLVVSRVTEDSARLSWTAPDAAFDSFTIFYLEYDQGGEAIVLTVPGSERSYDLTGLKPGTEYLVTIHGVKGGYISEPLSAIFTT

SEQ ID NO: 268 - protein, 89 aa, Artificial
  leukotoxin binding domain Luk278
LPAPKNLVVSRVTEDSARLSWTAPDAAFDSFPIFYWEFAVSGEAIVLTVPGSERSYDLTGLKPGTEYSVVIHGVKGGVISEPLSAIFTT

SEQ ID NO: 269 - protein, 89 aa, Artificial
  leukotoxin binding domain Luk279
LPAPKNLVVSRVTEDSARLSWTAPDAAFDSFQIIYFEFFIGGEAIVLTVPGSERSYDLTGLKPGTEYFVVIHGVKGGDLSAPLSAIFTT

SEQ ID NO: 270 - protein, 89 aa, Artificial
  leukotoxin binding domain Luk280
LPAPKNLVVSRVTEDSARLSWTAPDAAFDSFSIIYWEFASNGEAIVLTVPGSERSYDLTGLKPGTEYFVAIYGVKGGEISNPLSAIFTT

SEQ ID NO: 271 - protein, 89 aa, Artificial
  leukotoxin binding domain Luk281
LPAPKNLVVSRVTEDSARLSWTAPDAAFDSFTIFYFEFQTHGEAIVLTVPGSERSYDLTGLKPGTEYFVPITGVKGGWYSDPLSAIFTT

SEQ ID NO: 272 - protein, 89 aa, Artificial
  leukotoxin binding domain Luk282
LPAPKNLVVSRVTEDSARLSWTAPDAAFDSFIIIYWEYRTCGEAIVLTVPGSERSYDLTGLKPGTEYFVEIYGVKGGNTSPPLSAIFTT

SEQ ID NO: 273 - protein, 89 aa, Artificial
  leukotoxin binding domain Luk283
LPAPKNLVVSRVTEDSARLSWTAPDAAFDSITIHYFEPHTGGEAIVLTVPGSERSYDLTGLKPGTEYFVPIYGVKGGYISQPLSAIFTT

SEQ ID NO: 274 - protein, 89 aa, Artificial
  leukotoxin binding domain Luk285
LPAPKNLVVSRVTEDSARLSWTAPDAAFDSFPILYWENITTGEAIVLTVPGSERSYDLTGLKPGTEYFVVIHGVKGGFISGPLSAIFTT

SEQ ID NO: 275 - protein, 89 aa, Artificial
  leukotoxin binding domain Luk286
LPAPKNLVVSRVTEDSARLSWTAPDAAFDSFPIFYWEFQAAGEAIVLTVPGSERSYDLTGLKPGTEYFVEIYGVKGGWTSFPLSAIFTT

SEQ ID NO: 276 - protein, 89 aa, Artificial
  leukotoxin binding domain Luk287
LPAPKNLVVSRVTEDSARLSWTAPDAAFDSFVIVYWEWQCNGEAIVLTVPGSERSYDLTGLKPGTEYFVFIHGVKGGITSAPLSAIFTT

SEQ ID NO: 277 - protein, 89 aa, Artificial
  leukotoxin binding domain Luk288
LPAPKNLVVSRVTEDSARLSWTAPDAAFDSFAIHYWEPQGIGEAIVLTVPGSERSYDLTGLKPGTEYFVGIHGVKGGWISFPLSAIFTT

SEQ ID NO: 278 - protein, 89 aa, Artificial
  leukotoxin binding domain Luk289
LPAPKNLVVSRVTEDSARLSWTAPDAAFDSFIIPYWEYQYAGEAIVLTVPGSERSYDLTGLKPGTEYWVGIYGVKGGSISEPLSAIFTT

SEQ ID NO: 279 - protein, 89 aa, Artificial
  leukotoxin binding domain Luk290
LPAPKNLVVSRVTEDSARLSWTAPDAAFDSFTIFYIEPQFEGEAIVLTVPGSERSYDLTGLKPGTEYIVVIHGVKGGYISKPLSAIFTT

SEQ ID NO: 280 - protein, 89 aa, Artificial
  leukotoxin binding domain Luk291
LPAPKNLVVSRVTEDSARLSWTAPDAAFDSFNIIYWEYDPHGEAIVLTVPGSERSYDLTGLKPGTEYIVSIYGVKGGYISPPLSAIFTT

SEQ ID NO: 281 - protein, 89 aa, Artificial
  leukotoxin binding domain Luk292
LPAPKNLVVSRVTEDSARLSWTAPDAAFDSFAIEYWEWIDKGEAIVLTVPGSERSYDLTGLKPGTEYFVGIYGVKGGYISWPLSAIFTT

SEQ ID NO: 282 - protein, 89 aa, Artificial
  leukotoxin binding domain Luk293
LPAPKNLVVSRVTEDSARLSWTAPDAAFDSFSILYHEWSGWGEAIVLTVPGSERSYDLTGLKPGTEYFVFIHGVKGGYISPPLSAIFTT

SEQ ID NO: 283 - protein, 89 aa, Artificial
  leukotoxin binding domain Luk294
LPAPKNLVVSRVTEDSARLSWTAPDAAFDSFQILYWETAKSGEAIVLTVPGSERSYDLTGLKPGTEYFVEIYGVKGGWISWPLSAIFTT

SEQ ID NO: 284 - protein, 89 aa, Artificial
  leukotoxin binding domain Luk296
LPAPKNLVVSRVTEDSARLSWTAPDAAFDSFTIHYYEFKYQGEAIVLTVPGSERSYDLTGLKPGTEYFVVIHGVKGGFISPPLSAIFTT

SEQ ID NO: 285 - protein, 89 aa, Artificial
  leukotoxin binding domain Luk298
LPAPKNLVVSRVTEDSARLSWTAPDAAFDSFTIIYLEGNWSGEAIVLTVPGSERSYDLTGLKPGTEYFVSIYGVKGGFISEPLSAIFTT

SEQ ID NO: 286 - protein, 89 aa, Artificial
  leukotoxin binding domain Luk299
LPAPKNLVVSRVTEDSARLSWTAPDAAFDSFKIFYWEWPHSGEAIVLTVPGSERSYDLTGLKPGTEYFVAIHGVKGGWISKPLSAIFTT

SEQ ID NO: 287 - protein, 89 aa, Artificial
  leukotoxin binding domain Luk300
LPAPKNLVVSRVTEDSARLSWTAPDAAFDSFTISYWEYAGYGEAIVLTVPGSERSYDLTGLKPGTEYFVGIHGVKGGWISKPLSAIFTT

SEQ ID NO: 288 - protein, 89 aa, Artificial
  leukotoxin binding domain Luk301
LPAPKNLVVSRVTEDSARLSWTAPDAAFDSFHISYWEYYARGEAIVLTVPGSERSYDLTGLKPGTEYFVGIYGVKGGVISPPLSAIFTT

SEQ ID NO: 289 - protein, 89 aa, Artificial
  leukotoxin binding domain Luk302
LPAPKNLVVSRVTEDSARLSWTAPDAAFDSFKIWYLETGFRGEAIVLTVPGSERSYDLTGLKPGTEYFVPIYGVKGGYISQPLSAIFTT

SEQ ID NO: 290 - protein, 89 aa, Artificial
  leukotoxin binding domain Luk303
LPAPKNLVVSRVTEDSARLSWTAPDAAFDSFNIQYWEWNLGGEAIVLTVPGSERSYDLTGLKPGTEYFVAIYGVKGGAISDPLSAIFTT

SEQ ID NO: 291 - protein, 89 aa, Artificial
  leukotoxin binding domain Luk304
LPAPKNLVVSRVTEDSARLSWTAPDAAFDSFWIGYTELYEFGEAISLLVPGSERSYDLTGLKPGTEYSVAIAGVKGGAYSHPLHALFTT

SEQ ID NO: 292 - protein, 89 aa, Artificial
  leukotoxin binding domain Luk305
LPAPKNLVVSRVTEDSARLSWTAPDAAFDSFYIKYAEHVVWGEAIDLLVPGSERSYDLTGLKPGTEYEVGIAGVKGGTVSVPLSARFTT

SEQ ID NO: 293 - protein, 89 aa, Artificial
  leukotoxin binding domain Luk306
LPAPKNLVVSRVTEDSARLSWTAPDAAFDSFIILYDEIWPSGEAISLGVPGSERSYDLTGLKPGTEYFVAIHGVKGGNISDPLDAKFTT

SEQ ID NO: 294 - protein, 89 aa, Artificial
  leukotoxin binding domain Luk307
LPAPKNLVVSRVTEDSARLSWTAPDAAFDSFWIGYTESRYYGEAIDLLVPGSERSYDLTGLKPGTEYHVRISGVKGGAFSTPLWAAATT

SEQ ID NO: 295 - protein, 89 aa, Artificial
  leukotoxin binding domain Luk308
LPAPKNLVVSRVTEDSARLSWTAPDAAFDSFWIGYGERLRFGEAIDLLVPGSERSYDLTGLKPGTEYHVGISGVKGGWFSNPLRAIFTT

SEQ ID NO: 296 - protein, 89 aa, Artificial
  leukotoxin binding domain Luk309
LPAPKNLVVSRVTEDSARLSWTAPDAAFDSFKIFYLESDWEGEAIALWVPGSERSYDLTGLKPGTEYFVFIHGVKGGYISIPLHANFTT

SEQ ID NO: 297 - protein, 89 aa, Artificial
  leukotoxin binding domain Luk310
LPAPKNLVVSRVTEDSARLSWTAPDAAFDSFWIGYTETAKWGEAITLLVPGSERSYDLTGLKPGTEYRVGIGGVKGGGWSWPLDAIFTT

SEQ ID NO: 298 - protein, 88 aa, Artificial
  leukotoxin binding domain Luk311
LPAPKNLVVSRVTEDSARLSWTAPDAAFDSFWISYVEPDDGEAIELLVPGSERSYDLTGLKPGTEYIVQIDGVKGGTTSVPLNARFTT

SEQ ID NO: 299 - protein, 89 aa, Artificial
  leukotoxin binding domain Luk312
LPAPKNLVVSRVTEDSARLSWTAPDAAFDSFWIGYSEYPEYGEAIDLVVPGSERSYDLTGLKPGTEYRVGITGVKGGWISKPLNATFTT

SEQ ID NO: 300 - protein, 89 aa, Artificial
  leukotoxin binding domain Luk313
LPAPKNLVVSRVTEDSARLSWTAPDAAFDSFWIGYNEIGKWGEAIDLIVPGSERSYDLTGLKPGTEYAVGIDGVKGGSISEPLPASFTT

SEQ ID NO: 301 - protein, 89 aa, Artificial
  leukotoxin binding domain Luk314
LPAPKNLVVSRVTEDSARLSWTAPDAAFDSFAIFYTEFNFKGEAIPLDVPGSERSYDLTGLKPGTEYFVSIHGVKGGEISPPLEALFTT

SEQ ID NO: 302 - protein, 89 aa, Artificial
  leukotoxin binding domain Luk315
LPAPKNLVVSRVTEDSARLSWTAPDAAFDSFWISYQEPDEIGEAIELIVPGSERSYDLTGLKPGTEYFVQIDGVKGGTWSIPLNAYFTT

SEQ ID NO: 303 - protein, 88 aa, Artificial
  leukotoxin binding domain Luk317
LPAPKNLVVSRVTEDSARLSWTAPDAAFDSFWIGYHEFPTWGEAIDLLVPGSERSYDLTGLKPGTEYQVRISGVKGGTTSQPLQAAAT

SEQ ID NO: 304 - protein, 89 aa, Artificial
  leukotoxin binding domain Luk318
LPAPKNLVVSRVTEDSARLSWTAPDAAFDSFWIGYHETVGFGEAIALLVPGSERSYDLTGLKPGTEYAVAIDGVKGGWFSHPLVAYFTT

SEQ ID NO: 305 - protein, 89 aa, Artificial
  leukotoxin binding domain Luk319
LPAPKNLVVSRVTEDSARLSWTAPDAAFDSFWIGYFERFNWGEAIDLLVPGSERSYDLTGLKPGTEYQVQIDGVKGGDISIPLSARFTT

SEQ ID NO: 306 - protein, 89 aa, Artificial
  leukotoxin binding domain Luk320
LPAPKNLVVSRVTEDSARLSWTAPDAAFDSFWIGYSEWEQLGEAIDLIVPGSERSYDLTGLKPGTEYQVGIAGVKGGSSSFPLGAEFTT

SEQ ID NO: 307 - protein, 89 aa, Artificial
  leukotoxin binding domain Luk321
LPAPKNLVVSRVTEDSARLSWTAPDAAFDSFWIGYQEAATWGEAIDLSVPGSERSYDLTGLKPGTEYHVGIVGVKGGGVSTPLVAPFTT

SEQ ID NO: 308 - protein, 89 aa, Artificial
  leukotoxin binding domain Luk322
LPAPKNLVVSRVTEDSARLSWTAPDAAFDSFWIGYYESHRGGEAIDLLVPGSERSYDLTGLKPGTEYTVGITGVKGGTISYPLHAIFTT

SEQ ID NO: 309 - protein, 89 aa, Artificial
  leukotoxin binding domain Luk323
LPAPKNLVVSRVTEDSARLSWTEPDAAFDSFWIAYPEPGFQGEAISLLVPGSERSYDLTGLKPGTEYEVQIAGVKGGHVSWPLVATFTT

SEQ ID NO: 310 - protein, 89 aa, Artificial
  leukotoxin binding domain Luk324
LPAPKNLVVSRVTEDSARLSWTAPDAAFDSFWIAYEEVRAEGEAIELLVPGSERSYDLTGLKPGTEYVVGIDGVKGGGFSSPLVAHFTT

SEQ ID NO: 311 - protein, 89 aa, Artificial
  leukotoxin binding domain Luk326
LPAPKNLVVSRVTEDSARLSWTAPDAAFDSFWIAYYERTQQGEAIELLVPGSERSYDLTGLKPGTEYWVGIDGVKGGEVSQPLKAHFTT

SEQ ID NO: 312 - protein, 89 aa, Artificial
  leukotoxin binding domain Luk327
LPAPKNLVVSRVTEDSARLSWTAPDAAFDSFAIFYLEWLYHGEAIKLYVPGSERSYDLTGLKPGTEYYVVIHGVKGGFVSTPLFATFTT

SEQ ID NO: 313 - protein, 89 aa, Artificial
  leukotoxin binding domain Luk329
LPAPKNLVVSRVTEDSARLSWTAPDAAFDSFWIGYWEGIGYGEAITLLVPGSERSYDLTGLKPGTEYNVGIDGVKGGDFSTPLWARFTT

SEQ ID NO: 314 - protein, 89 aa, Artificial
  leukotoxin binding domain Luk330
LPAPKNLVVSRVTEDSARLSWTAPDAAFDSFWIGYHEFSTYGEAIDLLVPGSERSYDLTGLKPGTEYTVKIAGVKGGATSVPLVATFTT

SEQ ID NO: 315 - protein, 89 aa, Artificial
  leukotoxin binding domain Luk331
LPAPKNLVVSRVTEDSARLSWTAPDAAFDSFAIFYFEDDERGEAIVLNVPGSERSYDLTGLKPGTEYHVIIHGVKGGQISSPLYATFTT

SEQ ID NO: 316 - protein, 89 aa, Artificial
  leukotoxin binding domain Luk332
LPAPKNLVVSRVTEDSARLSWTAPDAAFDSFWIAYGEWEYPGEAIELLVPGSERSYDLTGLKPGTEYHVGIDGVKGGRVSYPLRAQFTT

SEQ ID NO: 317 - protein, 89 aa, Artificial
  leukotoxin binding domain Luk333
LPAPKNLVVSRVTEDSARLSWTAPDAAFDSFRIHYWEGLFVGEAIVLSVPGSERSYDLTGLKPGTEYAVPIYGVKGGSISKPLYALFTT

SEQ ID NO: 318 - protein, 89 aa, Artificial
  leukotoxin binding domain Luk334
LPAPKNLVVSRVTEDSARLSWTAPDAAFDSFHIGYHEAEGFGEAIALLVPGSERSYDLTGLKPGTEYPVGISGVKGGFVSFPLWARFTT

SEQ ID NO: 319 - protein, 89 aa, Artificial
  leukotoxin binding domain Luk335
LPAPKNLVVSRVTEDSARLSWTAPDAAFDSFWIGYNEIVNHGEAIDLVVPGSERSYDLTGLKPGTEYRVSIGGVKGGHWSVPLWARFTT

SEQ ID NO: 320 - protein, 89 aa, Artificial
  leukotoxin binding domain Luk336
LPAPKNLVVSRVTEDSARLSWTAPDAAFDSFWIGYHEWIGPGEAISLLVPGSERSYDLTGLKPGTEYWVGIAGVKGGWSSRPLSATFTT

SEQ ID NO: 321 - protein, 89 aa, Artificial
  leukotoxin binding domain Luk337
LPAPKNLVVSRVTEDSARLSWTAPDAAFDSFWIGYEEPLYFGEAIDLLVPGSERSYDLTGLKPGTEYRVHIGGVKGGRVSIPLEAEFTT

SEQ ID NO: 322 - protein, 89 aa, Artificial
  leukotoxin binding domain Luk338
LPAPKNLVVSRVTEDSARLSWTAPDAAFDSFWIAYEEDNAQGEAIELLVPGSERSYDLTGLKPGTEYDVKIDGVKGGRVSTPLVARFTT

SEQ ID NO: 323 - protein, 89 aa, Artificial
  leukotoxin binding domain Luk339
LPAPKNLVVSRVTEDSARLSWTAPDAAFDSFVIFYWEGQWNGEAILLDVPGSERSYDLTGLKPGTEYIVPIHGVKGGWISLPLVATFTT

SEQ ID NO: 324 - protein, 89 aa, Artificial
  leukotoxin binding domain Luk340
LPAPKNLVVSRVTEDSARLSWTAPDAAFDSFWIGYHESPYAGEAIDLVVPGSERSYDLTGLKPGTEYAVGIAGVKGGGYSIPLRAIFTT

SEQ ID NO: 325 - protein, 89 aa, Artificial
  leukotoxin binding domain Luk342
LPAPKNLVVSRVTEDSARLSWTAPDAAFDSFWIGYSEPTIYGEAIDLLVPGSERSYDLTGLKPGTEYFVGITGVKGGWNSRPLSAIFTT

SEQ ID NO: 326 - protein, 89 aa, Artificial
  leukotoxin binding domain Luk343
LPAPKNLVVSRVTEDSARLSWTAPDAAFDSFAIFYTETHWFGEAINLPVPGSERSYDLTGLKPGTEYGVIIHGVKGGYISDPLWAAFTT

SEQ ID NO: 327 - protein, 89 aa, Artificial
  leukotoxin binding domain Luk344
LPAPKNLVVSRVTEDSARLSWTAPDAAFDSFWISYVEPVFSGEAIELLVPGSERSYDLTGLKPGTEYIVGIGGVKGGGWSIPLEAHFTT

SEQ ID NO: 328 - protein, 89 aa, Artificial
  leukotoxin binding domain Luk345
LPAPKNLVVSRVTEDSARLSWTAPDAAFDSFSIFYIEAKFRGEAIRLGVPGSERSYDLTGLKPGTEYFVWIHGVKGGEISDPLEAPFTT

SEQ ID NO: 329 - protein, 89 aa, Artificial
  leukotoxin binding domain Luk346
LPAPKNLVVSRVTEDSARLSWTAPDAAFDSFWIAYYEIVGWGEAITLLVPGSERSYDLTGLKPGTKYVVLIDGVKGGLLSQPLHAEFAT

SEQ ID NO: 330 - protein, 89 aa, Artificial
  leukotoxin binding domain Luk347
LPAPKNLVVSRVTEDSARLSWTAPDAAFDSFWIGYHETTRFGEAIDLLVPGSERSYDLTGLKPGTEYVVAIQGVKGGHVSQPLRAPFTT

SEQ ID NO: 331 - protein, 89 aa, Artificial
  leukotoxin binding domain Luk348
LPAPKNLVVSRVTEDSARLSWTAPDAAFDSFSIIYLEASFRGEAIVLTVPGSERSYDLTGLKPGTEYFVSIYGVKGGHFSPPLDAIFTT

SEQ ID NO: 332 - protein, 89 aa, Artificial
  leukotoxin binding domain Luk349
LPAPKNLVVSRVTEDSARLSWTAPDAAFDSFWIGYREWIQWGEAISLLVPGSERSYDLTGLKPGTEYRVGITGVNGGVTSVPLHAKFTT

SEQ ID NO: 333 - protein, 89 aa, Artificial
  leukotoxin binding domain Luk350
LPAPKNLVVSRVTEDSARLSWTAPDAAFDSFWIAYHEGLSWGEAIDLLVPGSERSYDLTGLKPGTEYTVSIDGVKGGYTSEPLRASFTT

SEQ ID NO: 334 - protein, 89 aa, Artificial
  leukotoxin binding domain Luk351
LPAPKNLVVSRVTEDSARLSWTAPDAAFDSFWIGYDETLTYGEAITLLVPGSERSYDLTGLKPGTEYTVGIDGVKGGRNSVPLKATFTT

SEQ ID NO: 335 - protein, 89 aa, Artificial
  leukotoxin binding domain Luk353
LPAPKNLVVSRVTEDSARLSWTAPDAAFDSFWIGYHEPRAWGEAIDLLVPGSERSYDLTGLKPGTEYLVGIGGVKGGKQSKPLVAKFTT

SEQ ID NO: 336 - protein, 89 aa, Artificial
  leukotoxin binding domain Luk354
LPAPKNLVVSRVTEDSARLSWTAPDAAFDSFWIGYTEQKNHGEAIDLLVPGSERSYDLTGLKPGTEYEVNIAGVKGGGWSIPLNAWFTT

SEQ ID NO: 337 - protein, 89 aa, Artificial
  leukotoxin binding domain Luk355
LPAPKNLVVSRVTEDSARLSWTAPDAAFDSFKIVYVEIHYRGEAIHLSVPGSERSYDLTGLKPGTEYHVVIHGVKGGGISLPLDAPFTT

SEQ ID NO: 338 - protein, 89 aa, Artificial
  leukotoxin binding domain Luk356
LPAPKNLVVSRVTEDSARLSWTAPDATFDSFWIGYSEDQRTGEAIDLVVPGSERSYDLTGLKPGTEYRVAIAGVKGGYISQPLSANFTT

SEQ ID NO: 339 - protein, 89 aa, Artificial
  leukotoxin binding domain Luk357
LPAPKNLVVSRVTEDSARLSWTAPDAAFDSFTIHYFESLLTGEAISLVVPGSERSYDLTGLKPGTEYLVPIYGVKGGFISQPLIAIFTT

SEQ ID NO: 340 - protein, 89 aa, Artificial
  leukotoxin binding domain Luk358
LPAPKNLVVSRVTEDSARLSWTAPDAAFDSFAINYYEYYPAGEAIVLTVPGSERSYDLTGLKPGTEYFVAIYGVKGGYISPPLSAIFTT

SEQ ID NO: 341 - protein, 89 aa, Artificial
  leukotoxin binding domain Luk361
LPAPKNLVVSRVTEDSARLSWTAPDAAFDSFSIYYYEYYANGEAIVLTVPGSERSYDLTGLKPGTEYFVAIYGVKGGYVSDPLSAIFTT

SEQ ID NO: 342 - protein, 89 aa, Artificial
  leukotoxin binding domain Luk362
LPAPKNLVVSRVTEDSARLSWTAPDAAFDSFPIYYLEYSFTGEAIVLTVPGSERSYDLTGLKPGTEYAVYIYGVKGGWISDPLSAIFTT

SEQ ID NO: 343 - protein, 89 aa, Artificial
  leukotoxin binding domain Luk363
LPAPKNLVVSRVTEDSARLSWTAPDAAFDSFRIYYYEWASYGEAIVLTVPGSERSYDLTGLKPGTEYFVGIYGVKGGHISRPLSAIFTT

SEQ ID NO: 344 - protein, 89 aa, Artificial
  leukotoxin binding domain Luk364
LPAPKNLVVSRVTEDSARLSWTAPDAAFDSFRIFYHEYSYRGEAIVLTVPGSERSYDLTGLKPGTEYLVIIHSVKGGSVSSPLSAIFTT

SEQ ID NO: 345 - protein, 89 aa, Artificial
  leukotoxin binding domain Luk365
LPAPKNLVVSRVTEDSARLSWTAPDAAFDSFTIYYYEYWYGGEAIVLTVPGSERSYDLTGLKPGTEYWVGIYGVKGGYISSPLSAIFTT

SEQ ID NO: 346 - protein, 89 aa, Artificial
  leukotoxin binding domain Luk366
LPAPKNLVVSRVTEDSARLSWTAPDAAFDSFAIFYYEFNWGGEAIVLTVPGSERSYDLTGLKPGTEYWVGIYGVKGGYISYPLSAIFTT

SEQ ID NO: 347 - protein, 89 aa, Artificial
  leukotoxin binding domain Luk368
LPAPKNLVVSRVTEDSARLSWTAPDAAFDSFAIYYFESINLGDAIVLTVPGSERSYDLTGLKPGTEYYVYIYGVKGGYISYPLSAIFTT

SEQ ID NO: 348 - protein, 89 aa, Artificial
  leukotoxin binding domain Luk369
LPAPKNLVVSRVTEDSARLSWTAPDAAFDSFRIFYYEYGGGGEAIVLTVPGSERSYDLTGLKPGTEYHVGIYGVKGGYISPPLSAIFTT

SEQ ID NO: 349 - protein, 89 aa, Artificial
  leukotoxin binding domain Luk370
LPAPKNLVVSRVTEDSARLSWTAPDAAFDSFSIYYFEYWTYGEAIVLTVPGSERSYDLTGLKPGTEYYVYIYGVKGGYISDPLSAIFTT

SEQ ID NO: 350 - protein, 88 aa, Artificial
  leukotoxin binding domain Luk371
LPAPKNLVVSRVIEDSARLSWTAPDAAFDSFTIFYYEYDSGEAIVLTVPGSERSYDLTGLKPGTEYTVAIFGVKGGYISAPLSAIFTT

SEQ ID NO: 351 - protein, 89 aa, Artificial
  leukotoxin binding domain Luk372
LPAPKNLVVSRVTEDSARLSWTAPDAAFDSFLIGYEEYANAGEAIVLTVPGSERSYDLTGLKPGTEYLVFIYGVKGGYYSYPLSAIFTT

SEQ ID NO: 352 - protein, 89 aa, Artificial
  leukotoxin binding domain Luk373
LPAPKNLVVSRVTEDSARLSWTAPDAAFDSFHIYYFEYINLGEAIVLTVPGSERSYDLTGLKPGTEYFVYIHGVKGGFVSDPLSAIFTT

SEQ ID NO: 353 - protein, 89 aa, Artificial
  leukotoxin binding domain Luk374
LPAPKNLVVSRVTEDSARLSWTAPDAAFDSFVIEYWEYRLAGEAIVLTVPGSERSYDLTGLKPGTEYFVGIYGVKGGAVSLPLSAIFTT

SEQ ID NO: 354 - protein, 89 aa, Artificial
  leukotoxin binding domain Luk375
LPAPKNLVVSRVTEDSARLSWTAPDAAFDSFHIDYWEYVFLGEAIVLTVPGSERSYDLTGLKPGTEYFVSITGVKGGRYSYPLSAIFTT

SEQ ID NO: 355 - protein, 89 aa, Artificial
  leukotoxin binding domain Luk376
LPAPKNLVVSRVTEDSARLSWTAPDAAFDSFTIPYYEYWWSGEAIVLTVPGSERSYDLTGLKPGTEYWVGIYGVKGGYISSPLSAIFTT

SEQ ID NO: 356 - protein, 89 aa, Artificial
  leukotoxin binding domain Luk377
LPAPKNLVVSRVTEDSARLSWTAPDAAFDSFWINYWEYYPHGEAIVLTVPGSERSYDLTGLKPGTEYFVGIYGVKGGSYSHPLSAIFTT

SEQ ID NO: 357 - protein, 89 aa, Artificial
  leukotoxin binding domain Luk378
LPAPKNLVVSRVTEDSARLSWTAPDAAFDSFAIFYHEDAYTGEAIVLTVPGSERSYDLTGLKPGTEYFVVIHGVKGGFLSRPLSAIFTT

SEQ ID NO: 358 - protein, 89 aa, Artificial
  leukotoxin binding domain Luk379
LPAPKNLVVSRVTEDSARLSWTAPDAAFDSFYILYHEYEYSGEAIVLTVPGSERSYDLTGLKPGTEYFVAIYGVKGGLYSAPLSAIFTT

SEQ ID NO: 359 - protein, 85 aa, Artificial
  leukotoxin binding domain Luk380
LPAPKNLVVSRVNEDSARLSWTAPDAAFDSFDIVYGVGEAIVLTVPGSERSYDLTGLKPGTEYYVPIAGVKGGGVSWPLSAIFTT

SEQ ID NO: 360 - protein, 89 aa, Artificial
  leukotoxin binding domain Luk381
LPAPKNLVVSRVTEDSARLSWTAPDAAFDSFRIYYYEYYKYGEAIVLTVPGSERSYDLTGLKPGTEYFVAIYGVKGGEISDPLSAIFTT

SEQ ID NO: 361 - protein, 89 aa, Artificial
  leukotoxin binding domain Luk382
LPAPKNLVVSRVTEDSARLSWTAPDAAFDSFGIIYDETAQYGEAIVLTVPGSERSYDLTGLKPGTEYLVPIHGVKGGTISYPLSAIFTT

SEQ ID NO: 362 - protein, 94 aa, Artificial
  leukotoxin binding domain Luk390
LPAPKNLVVSRVTEDSARLSWTYIHHGFDSFLIQYQESEKVGEAIVLTVPGSERSYDLTGLKPGTEYTVSIYGVVWGYWNPTQYSNPLSAIFTT

SEQ ID NO: 363 - protein, 94 aa, Artificial
  leukotoxin binding domain Luk394
LPAPKNLVVSRVTEDSARLSWDQYRLNFDSFLIQYQESEKVGEAIVLTVPGSERSYDLTGLKPGTEYTVSIYGVNWGYFLAPEISNPLSAIFTT

SEQ ID NO: 364 - protein, 95 aa, Artificial
  leukotoxin binding domain Luk399
LPAPKNLVVSRVTEDSARLSWPGQTRKFNIFDSFLIQYQESEKVGEAIVLTVPGSERSYDLTGLKPGTEYTVSIYGVVGIFLTFGSNPLSAIFTT

SEQ ID NO: 365 - protein, 93 aa, Artificial
  leukotoxin binding domain Luk409
LPAPKNLVVSRVTEDSARLSWKYTLYQHYFDSFLIQYQESEKVGEAIVLTVPGSERSYDLTGLKPGTEYTVSIYGVLAWWSFGSNPLSAIFTT

SEQ ID NO: 366 - protein, 89 aa, Artificial
  leukotoxin binding domain Luk412
LPAPKNLVVSRVTEDSARLSWTAPDAAFDSFGIGYLEYPWYGEAIVLTVPGSERSYDLTGLKPGTEYFVDIYGVKGGWWSYPLSAIFTT

SEQ ID NO: 367 - protein, 89 aa, Artificial
  leukotoxin binding domain Luk414
LPAPNLLVVSRVTEDSARLSWTAPDAAFDSFWIDYIETYYYGEAIVLTVPGSERSYDLTGLKPGTEYLVDIYGVKGGWYSLPLSAIFTT

SEQ ID NO: 368 - protein, 89 aa, Artificial
  leukotoxin binding domain Luk415
LPAPKNLVVSRVTEDSARLSWTAPDAAFDSFEISYTEYGISGEAIVLTVPGSERSYDLTGLKPGTEYFVDIYGVKGGYLSYPLSAIFTT

SEQ ID NO: 369 - protein, 89 aa, Artificial
  leukotoxin binding domain Luk417
LPAPKNLVVSRVTEDSARLSWTAPDAAFDSFNIDYFEYYEFGEAIVLTVPGSERSYDLTGLKPGTEYFVDIYGVKGGSWSLPLSAIFTT

SEQ ID NO: 370 - protein, 94 aa, Artificial
  leukotoxin binding domain Luk420
LPAPKNLVVSRVTEDSARLSWWLGRFNFDSFLIQYQESEKVGEAIVLTVPGSERSYDLTGLKPGTEYTVSIYGVKQWIISEESLSNPLSAIFTT

SEQ ID NO: 371 - protein, 94 aa, Artificial
  leukotoxin binding domain Luk428
LPAPKNLVVSRVTEDSARLSWGIKEETIIFDSFLIQYQESEKVGEAIVLTVPGSERSYDLTGLKPGTEYTVSIYGVNIIELHLWSNPLSAIFTT

SEQ ID NO: 372 - protein, 97 aa, Artificial
  leukotoxin binding domain Luk438
LPAPKNLVVSRVTEDSARLSWWRKPKRWRHFDSFLIQYQESEKVGEAIVLTVPGSERSYDLTGLKPGTEYTVSIYGVAPDTPTPVIISNPLSAIFTT

SEQ ID NO: 373 - protein, 97 aa, Artificial
  leukotoxin binding domain Luk445
LPAPKNLVVSRVTEDSARLSWEVNTKTSNKFDSFLIQYQESEKVGEAIVLTVPGSERSYDLTGLKPGTEYTVSIYGVGYWLTNVVLASNPLSAIFTT

SEQ ID NO: 374 - protein, 98 aa, Artificial
  leukotoxin binding domain Luk447
LPAPKNLVVSRVTEDSARLSWGIDDYFVHFFDSFLIQYQESEKVGEAIVLTVPGSERSYDLTGLKPGTEYTVSIYGVSIHFEFTTYSRSNPLSAIFTT

SEQ ID NO: 375 - protein, 89 aa, Artificial
  leukotoxin binding domain Luk449
LPAPKNLVVSRVTEDSARLSWTAPDAAFDSFDISYDEYPEFGEAIVLTVPGSERSYDLTGLKPGTEYLVDIIGVKGGEISLPLSAIFTT

SEQ ID NO: 376 - protein, 89 aa, Artificial
  leukotoxin binding domain Luk452
LPAPKNLVVSRVTEDSARLSWTAPDAAFDSFNIHYAEYPDFGEAIVLTVPGSERSYDLTGLKPGTEYIVDIWGVKGGLGSWPLSAIFTT

SEQ ID NO: 377 - protein, 95 aa, Artificial
  leukotoxin binding domain Luk460
LPAPKNLVVSRVTEDSARLSWIWGGESFDSFLIQYQESEKVGEAIVLTVPGSERSYDLTGLKPGTEYTVSIYGVGQIGFIYRPEGSNPLSAIFTT

SEQ ID NO: 378 - protein, 93 aa, Artificial
  leukotoxin binding domain Luk461
LPAPKNLVVSRVTEDSARLSWLGPTATVFDSFLIQYQESEKVGEAIVLTVPGSERSYDLTGLKPGTEYTVSIYGVWSLLHHRFSNPLSAIFTT

SEQ ID NO: 379 - protein, 94 aa, Artificial
  leukotoxin binding domain Luk462
LPAPKNLVVSRVTEDSARLSWHPIWVDFDSFLIQYQESEKVGEAIVLTVPGSERSYDLTGLKPGTEYTVSIYGVRGDGFEVILHSNPLSAIFTT

SEQ ID NO: 380 - protein, 96 aa, Artificial
  leukotoxin binding domain Luk463
LPAPKNLVVSRVTEDSARLSWKWFKTTAFDSFLIQYQESEKVGEAIVLTVPGSERSYDLTGLKPGTEYTVSIYGVLHASEIHQWESSNPLSAIFTT

SEQ ID NO: 381 - protein, 95 aa, Artificial
  leukotoxin binding domain Luk464
LPAPKNLVVSRVTEDSARLSWWWPVAPFDSFLIQYQESEKVGEAIVLTVPGSERSYDLTGLKPGTEYTVSIYGVGAINYVYFPTWSNPLSAIFTT

SEQ ID NO: 382 - protein, 93 aa, Artificial
  leukotoxin binding domain Luk465
LPAPKNLVVSRVTEDSARLSWVTDPGTNFDSFLIQYQESEKVGEAIVLTVPGSERSYDLTGLKPGTEYTVSIYGVWSWVHSRYSNPLSAIFTT

SEQ ID NO: 383 - protein, 96 aa, Artificial
  leukotoxin binding domain Luk467
LPAPKNLVVSRVTEDSARLSWPWLQYPFFDSFLIQYQESEKVGEAIVLTVPGSERSYDLTGLKPGTEYTVSIYGVGYLDWHIFQLASNPLSAIFTT

SEQ ID NO: 384 - protein, 99 aa, Artificial
  leukotoxin binding domain Luk468
LPAPKNLVVSRVTEDSARLSWQPSHGEFANFDSFLIQYQESEKVGEAIVLTVPGSERSYDLTGLKPGTEYTVSIYGVQPWYRGGHIYDFSNPLSAIFTT

SEQ ID NO: 385 - protein, 97 aa, Artificial
  leukotoxin binding domain Luk470
LPAPKNLVVSRVTEDSARLSWINYSDPDFFDSFLIQYQESEKVGEAIVLTVPGSERSYDLTGLKPGTEYTVSIYGVYHWWYRGTPVVSNPLSAIFTT

SEQ ID NO: 386 - protein, 97 aa, Artificial
  leukotoxin binding domain Luk473
LPAPKNLVVSRVTEDSARLSWLEGFFPQPLFDSFLIQYLESEKVGEAIVLTVPGSERSYDLTGLKPGTEYTVSIYGVPWYHHRWWFASNPLSAIFTT

SEQ ID NO: 387 - protein, 99 aa, Artificial
  leukotoxin binding domain Luk475
LPAPKNLVVSRVTEDSARLSWKQHTNTHYQFDSFLIQYQESEKVGEAIVLTVPVSERSYDLTGLKPGTEYTVSIYGVRWIDNHLKFNVHSNPLSAIFTT

SEQ ID NO: 388 - protein, 97 aa, Artificial
  leukotoxin binding domain Luk476
LPAPKNLVVSRVTEDSARLSWLEGFFPQPLFDSFLIQYQESEKVGEAIVLTVPGSERSYDLTGLKPGTEYTVSIYGVPWYHHRWWFASNPLSAIFTT

SEQ ID NO: 389 - protein, 98 aa, Artificial
  leukotoxin binding domain Luk478
LPAPKNLVVSRVTEDSARLSWLEGFFPQPLFDSFLIQYQESEKVGEAIVLTVPGSERSYDLTGLKPGTEYTVSIYGVASRWHSFPVTTSNPLSAIFTT

SEQ ID NO: 390 - protein, 97 aa, Artificial
  leukotoxin binding domain Luk479
LPAPKNLVVSRVTEDSARLSWLEGFFPQPLFDSFLIQYQESEKVGEAIVLTVPGSERSYGLTGLKPGTEYTVSIYGVPWYHHRWWFASNPLSAIFTT

SEQ ID NO: 391 - protein, 89 aa, Artificial
  leukotoxin binding domain Luk483
LPAPKNLVVSRVTEDSARLSWTAPDAAFDSFRIFYYERFTWGEAIVLTVPGSERSYDLTGLKPGTEYPVHIWGVKGGIDSRPLSAIFTT

SEQ ID NO: 392 - protein, 89 aa, Artificial
  leukotoxin binding domain Luk486
LPAPKNLVVSRVTEDSARLSWTAPDAAFDSFAIRYGEETVHGEAIALIVPGSERSYDLTGLKPGTEYPVAIAGVKGGTWSIPLSAIFTT

SEQ ID NO: 393 - protein, 89 aa, Artificial
  leukotoxin binding domain Luk487
LPAPKNLVVSRVTEDSARLSWTAPDAAFDSFAIHYLEFHYAGEAIVLTVPGSERSYDLTGLKPGTEYWVVIYGVKGDLISGPLSAIFTT

SEQ ID NO: 394 - protein, 94 aa, Artificial
  leukotoxin binding domain Luk498
LPAPKNLVVSRVTEDSARLSWLPGPFRRFDSFLIQYQESEKVGEAIVLTVPGSERSYDLTGLKPGTEYTVSIYGVVNHEWYHAFSNPLSAIFTT

SEQ ID NO: 395 - protein, 94 aa, Artificial
  leukotoxin binding domain Luk499
LPAPKNLVVSRVTEDSARLSWIGRELIWFDSFLIQYQESEKVGEAIVLTVPGSERSYDLTGLKPGTEYTVSIYGVVTHEWRSEFSNPLSAIFTT

SEQ ID NO: 396 - protein, 94 aa, Artificial
  leukotoxin binding domain Luk500
LPAPKNLVVSRVTEDSARLSWKKPSYYIFDSFLIQYQESEKVGEAIVLTVPGSERSYDLTGLKPGTEYTVSIYGVVNHEWYHAFSNPLSAIFTT

SEQ ID NO: 397 - protein, 93 aa, Artificial
  leukotoxin binding domain Luk505
LPAPKNLVVSRVTEDSARLSWQQAARWFDSFLIQYQESEKVGEAIVLTVPGSERSYDLTGLKPGTEYTVSIYGVVTREWFHSFSNPLSAIFTT

SEQ ID NO: 398 - protein, 94 aa, Artificial
  leukotoxin binding domain Luk507
LPAPKNLVVSRVTEDSARLSWQHHGFRLFDSFLIQYQESEKVGEAIVLTVPGSERSYDLTGLKPGTEYTVSIYGVFTHEWFHEFSNPLSAIFTT

SEQ ID NO: 399 - protein, 96 aa, Artificial
  leukotoxin binding domain Luk510
LPAPKNLVVSRVTEDSARLSWDEYSVTTWWFDSFLIQYQESEKVGEAIVLTVPGSERSYDLTGLKPGTEYTVSIYGVNELYRPWVASNPLSAIFTT

SEQ ID NO: 400 - protein, 97 aa, Artificial
  leukotoxin binding domain Luk513
LPAPKNLVVSRVTEDSARLSWWTGGWRRNPFDSFLIQYQESEKVGEAIVLTVPGSERSYDLTGLKPGTEYTVSIYGVQLHRTIIAGESNPLSAIFTT

SEQ ID NO: 401 - protein, 95 aa, Artificial
  leukotoxin binding domain Luk516
LPAPKNLVVSRVTEDSARLSWVGANSRHWFDSFLIQYQESEKVGEAIVLTVPGSERSYDLTGLKPGTEYTVSIYGVAVSEWFHSFSNPLSAIFTT

SEQ ID NO: 402 - protein, 96 aa, Artificial
  leukotoxin binding domain Luk517
LPAPKNLVVSRVTEDSARLSWVNHLEGEAWFDSFLIQYQESEKVGEAIVLTVPGSERSYDLTGLKPGTEYTVSIYGVQTHEWWHKFSNPLSAIFTT

SEQ ID NO: 403 - protein, 97 aa, Artificial
  leukotoxin binding domain Luk519
LPAPKNLVVSRVTEDSARLSWDLEHHNYHYFDSFLIQYQESEKVGEAIVLTVPGSERSYDLTGLKPGTEYTVSIYGVWFLQPAIHPPSNPLSAIFTT

SEQ ID NO: 404 - protein, 89 aa, Artificial
  leukotoxin binding domain Luk520
LPAPKNLVVSRVTEDSARLSWTAPDAAFDSFAIFYYEYWSNGEAIVLTVPGSERSYDLTGLKPGTEYWVGIHGVKGGLISHPLSAIFTT

SEQ ID NO: 405 - protein, 89 aa, Artificial
  leukotoxin binding domain Luk521
LPAPKNLVVSRVTEDSARLSWTAPDAAFDSFIITYEEATLNGEAIVLTVPGSERSYDLTGLKPGTEYTVGITGVKGGLGSYPLSAIFTT

SEQ ID NO: 406 - protein, 89 aa, Artificial
  leukotoxin binding domain Luk522
LPAPKNLVVSRVTEDSARLSWTAPDAAFDSFTIFYLEQRFQGEAIVLTVPGSERSYDLTGLKPGTEYAVIIHGVKGGWISFPLSAIFTT

SEQ ID NO: 407 - protein, 89 aa, Artificial
  leukotoxin binding domain Luk523
LPAPKNLVVSRVTEDSARLSWTAPDAAFDSFNIPYLERQLYGEAIVLTVPGSERSYDLTGLKPGTEYTVTIGGVKGGAPSRPLSAIFTT

SEQ ID NO: 408 - protein, 89 aa, Artificial
  leukotoxin binding domain Luk524
LPAPKNLVVSRVTEDSARLSWTAPDAAFDSFFIFYLEYAHPGEAIVLTVPGSERSYDLTGLKPGTEYHVIIHGVKGGLISEPLSAIFTT

SEQ ID NO: 409 - protein, 89 aa, Artificial
  leukotoxin binding domain Luk525
LPAPKNLVVSRVTEDSARLSWTAPDAAFDSFYIFYWESVTGGEAIVLTVPGSERSYDLTGLKPGTEYIVIIHGVKGGLISDPLSAIFTT

SEQ ID NO: 410 - protein, 89 aa, Artificial
  leukotoxin binding domain Luk526
LPAPKNLVVSRVTEDSARLSWTAPDAAFDSFPIFYDEHHQWGEAIVLTVPGSERSYDLTGLKPGTEYWVAIYGVKGGYYSSPLSAIFTT

SEQ ID NO: 411 - protein, 89 aa, Artificial
  leukotoxin binding domain Luk527
LPAPKNLVVSRVTEDSARLSWTAPDAAFDSFHIFYWEPNEVGEAIVLTVPGSERSYDLTGLKPGTEYFVEIYGVKGGEISYPLSAIFTT

SEQ ID NO: 412 - protein, 89 aa, Artificial
  leukotoxin binding domain Luk528
LPAPKNLVVSRVTEDSARLSWTAPDAAFDSFTIDYREETPKGEAIVLTVPGSERSYDLTGLKPGTEYWVIILGVKGGGDSFPLSAIFTT

SEQ ID NO: 413 - protein, 89 aa, Artificial
  leukotoxin binding domain Luk529
LPAPKNLVVSRVTEDSARLSWTAPDAAFDSFGIYYGEWNPKGEAIVLTVPGSERSYDLTGLKPGTEYWVIISGVKGGPQSIPLSAIFTT

SEQ ID NO: 414 - protein, 89 aa, Artificial
  leukotoxin binding domain Luk530
LPAPKNLVVSRVTEDSARLSWTAPDAAFDSFGIFYHEIEENGEAIVLTVPGSERSYDLTGLKPGTEYFVAIHGVKGGVISTPLSAIFTT

SEQ ID NO: 415 - protein, 89 aa, Artificial
  leukotoxin binding domain Luk531
LPAPKNLVVSRVTEDSARLSWTAPDAAFDSFRIFYYELYHAGEAIVLTVPGSERSYDLTGLKPGTEYFVIIHGVKGGQISLPLSAIFTT

SEQ ID NO: 416 - protein, 89 aa, Artificial
  leukotoxin binding domain Luk532
LPAPKNLVVSRVTEDSARLSWTAPDAAFDSFTIFYLELESSGEAIVLTVPGSERSYDLTGLKPGTEYNVIIHGVKGGFISSPLSAIFTT

SEQ ID NO: 417 - protein, 89 aa, Artificial
  leukotoxin binding domain Luk533
LPAPKNLVVSRVTEDSARLSWTAPDAAFDSFPIFYVELRNPGEAIVLTVPGSERSYDLTGLKPGTEYHVVIHGVKGGFISHPLSAIFTT

SEQ ID NO: 418 - protein, 89 aa, Artificial
  leukotoxin binding domain Luk534
LPAPKNLVVSRVTEDSARLSWTAPDAAFDSFTIFYTEWNEFGEAIVLTVPGSERSYDLTGLKPGTEYFVIIHGVKGGQISVPLSAIFTT

SEQ ID NO: 419 - protein, 89 aa, Artificial
  leukotoxin binding domain Luk535
LPAPKNLVVSRVTEDSARLSWTAPDAAFDSFVIFYLEPTTQGEAIVLTVPGSERSYDLTGLKPGTEYFVIIHGVKGGPVSGPLSAIFTT

SEQ ID NO: 420 - protein, 89 aa, Artificial
  leukotoxin binding domain Luk536
LPAPKNLVVSRVTEDSARLSWTAPDAAFDSFWIAYIETDGWGEAIVLTVPGSERSYDLTGLKPGTEYFVPIHGVKGGYISQPLSAIFTT

SEQ ID NO: 421 - protein, 89 aa, Artificial
  leukotoxin binding domain Luk537
LPAPKNLVVSRVTEDSARLSWTAPDAAFDSFAIFYHEHKIRGEAIVLTVPGSERSYDLTGLKPGTEYLVIIHGVKGGYISLPLSAIFTT

SEQ ID NO: 422 - protein, 89 aa, Artificial
  leukotoxin binding domain Luk538
LPAPKNLVVSRVTEDSARLSWTAPDAAFDSFPIFYLERANRGEAIVLTVPGSERSYDLTGLKPGTEYFVIIHGVKGGTISDPLSAIFTT

SEQ ID NO: 423 - protein, 89 aa, Artificial
  leukotoxin binding domain Luk539
LPAPKNLVVSRVTEDSARLSWTAPDAAFDSFAIFYLETLYHGEAIVLTVPGSERSYDLTGLKPGTEYLVVIHGVKGGIISSPLSAIFTT

SEQ ID NO: 424 - protein, 89 aa, Artificial
  leukotoxin binding domain Luk540
LPAPKNLVVSRVTEDSARLSWTAPDAAFDSFHIEYPEDTEQGEAIVLTVPGSERSYDLTGLKPGTEYNVHITGVKGGSKSAPLSAIFTT

SEQ ID NO: 425 - protein, 89 aa, Artificial
  leukotoxin binding domain Luk541
LPAPKNLVVSRVTEDSARLSWTAPDAAFDSFNILYTETEQSGEAIVLTVPGSERSYDLTGLKPGTEYIVIIHGVKGGFISGPLSAIFTT

SEQ ID NO: 426 - protein, 89 aa, Artificial
  leukotoxin binding domain Luk542
LPAPKNLVVSRVTEDSARLSWTAPDAAFDSFTIFYPEFRGDGEAIVLTVPGSERSYDLTGLKPGTEYGVIIHGVKGGGDSNPLSAIFTT

SEQ ID NO: 427 - protein, 89 aa, Artificial
  leukotoxin binding domain Luk543
LPAPKNLVVSRVTEDSARLSWTAPDAAFDSFAIFYTETFHYGEAIVLTVPGSERSYDLTGLKPGTEYLVVIHGVKGGDISAPLSAIFTT

SEQ ID NO: 428 - protein, 89 aa, Artificial
  leukotoxin binding domain Luk544
LPAPKNLVVSRVTEDSARLSWTAPDAAFDSFTIHYLEEFWLGEAIVLTVPGSERSYDLTGLKPGTEYFVAIYGVKGGFISVPLSAIFTT

SEQ ID NO: 429 - protein, 89 aa, Artificial
  leukotoxin binding domain Luk545
LPAPKNLVVSRVTEDSARLSWTAPDAAFDSFVIAYIEERWSGEAIVLTVPGSERSYDLTGLKPGTEYFVLIHGVKGGFISNPLSAIFTT

SEQ ID NO: 430 - protein, 89 aa, Artificial
  leukotoxin binding domain Luk546
LPAPKNLVVSRVTEDSARLSWTAPDAAFDSFSIYYGEWPHGGEAIVLTVPGSERSYDLTSLKPGTEYFVLIIGVKGGQLSHPLSAIFTT

SEQ ID NO: 431 - protein, 89 aa, Artificial
  leukotoxin binding domain Luk547
LPAPKNLVVSRVTEDSARLSWTAPDAAFDSFTIFYLESSGTGEAIVLTVPGSERSYDLTGLKPGTEYLVIIHGVKGGRISNPLSAIFTT

SEQ ID NO: 432 - protein, 89 aa, Artificial
  leukotoxin binding domain Luk548
LPAPKNLVVSRVTEDSARLSWTAPDAAFDSFAIYYGEWHPDGEAIVLTVPGSERSYDLTGLKPGTEYWVFILGVKGGQNSQPLSAIFTT

SEQ ID NO: 433 - protein, 89 aa, Artificial
  leukotoxin binding domain Luk549
LPAPKNLVVSRVTEDSARLSWTAPDAAFDSFTIFYAESGNWGEAIVLTVPGSERSYDLTGLKPGTEYFVFIWGVKGGHESHPLSAIFTT

SEQ ID NO: 434 - protein, 89 aa, Artificial
  leukotoxin binding domain Luk550
LPAPKNLVVSRVTEDSARLSWTAPDAAFDSFAIFYAETDTKGEAIVLTVPGSERSYDLTGLKPGTEYLVIIHGVKGGSISVPLSAIFTT

SEQ ID NO: 435 - protein, 89 aa, Artificial
  leukotoxin binding domain Luk551
LPAPKNLVVSRVTEDSARLSWTAPDAAFDSFRIFYQEYSNHGEAIVLTVPGSERSYDLTGLKPGTEYFVPIYGVKGGFISRPLSAIFTT

SEQ ID NO: 436 - protein, 89 aa, Artificial
  leukotoxin binding domain Luk552
LPAPKNLVVSRVTEDSARLSWTAPDAAFDSFQIFYDENLWLGEAIVLTVPGSERSYDLTGLKPGTEYFVAIHGVKGGFISQPLSAIFTT

SEQ ID NO: 437 - protein, 89 aa, Artificial
  leukotoxin binding domain Luk553
LPAPKNLVVSRVTEDSARLSWTAPDAAFDSFHIFYAEHEKWGEAIVLTVPGSERSYDLTGLKPGTEYWVAIHGVKGGHISRPLSAIFTT

SEQ ID NO: 438 - protein, 89 aa, Artificial
  leukotoxin binding domain Luk554
LPAPKNLVVSRVTEDSARLSWTAPDAAFDSFSIFYLETFRRGEAIVLTVPGSERSYDLTGLKPGTEYLVIIHGVKGGYVSDPLSAIFTT

SEQ ID NO: 439 - protein, 89 aa, Artificial
  leukotoxin binding domain Luk555
LPAPKNLVVSRVTEDSARLSWTAPDAAFDSFSIFYPETNYQGEAIVLTVPGSERSYDLTGLKPGTEYLVVIHGVKGGYISDPLSAIFTT

SEQ ID NO: 440 - protein, 89 aa, Artificial
  leukotoxin binding domain Luk556
LPAPKNLVVSRVTEDSARLSWTAPDAAFDSFAIFYIEEETNGEAIVLTVPGSERSYDLTGLKPGTEYQVIIHGVKGGFISLPLSAIFTT

SEQ ID NO: 441 - protein, 89 aa, Artificial
  leukotoxin binding domain Luk557
LPAPKNLVVSRVTEDSARLSWTAPDAAFDSFVIFYPEVNFRGEAIVLTVPGSERSYDLTGLKPGTEYLVIIHGVKGGYISTPLSAIFTT

SEQ ID NO: 442 - protein, 89 aa, Artificial
  leukotoxin binding domain Luk558
LPAPKNLVVSRVTEDSARLSWTAPDAAFDSFAIFYHEWWKSGEAIVLTVPGSERSYDLTGLKPGTEYHVVIHGVKGGHISTPLSAIFTT

SEQ ID NO: 443 - protein, 89 aa, Artificial
  leukotoxin binding domain Luk559
LPAPKNLVVSRVTEDSARLSWTAPDAAFDSFTIHYPETRPTGEAIVLTVPGSERSYDLTGLKPGTEYFVVIYGVKGGWISPPLSAIFTT

SEQ ID NO: 444 - protein, 89 aa, Artificial
  leukotoxin binding domain Luk560
LPAPKNLVVSRVTEDSARLSWTAPDAAFDSFHIFYIEHVQVGEAIVLTVPGSERSYDLTGLKPGTEYFVIIHGVKGGIISPPLSAIFTT

SEQ ID NO: 445 - protein, 90 aa, Artificial
  leukotoxin binding domain Luk561
LPAPKNLVVSRVTEDSARLSWTAPDAAFDSFTIFYYPELYFHGEAIVLTVPGSERSYDLTGLKPGTEYLVVIHGVKGGFISPPLSAIFTT

SEQ ID NO: 446 - protein, 89 aa, Artificial
  leukotoxin binding domain Luk562
LPAPKNLVVSRVTEDSARLSWTAPDAAFDSFAIFYKEYTHGGEAIVLTVPGSERSYDLTGLKPGTEYWVIIHSVKGGSISYPLSAIFTT

SEQ ID NO: 447 - protein, 89 aa, Artificial
  leukotoxin binding domain Luk563
LPAPKNLVVSRVTEDSARLSWTAPDAAFDSFQIFYPEHYQDGEAIVLTVPGSERSYDLTGLKPGTEYLVVIHGVKGGWISSPLSAIFTT

SEQ ID NO: 448 - protein, 89 aa, Artificial
  leukotoxin binding domain Luk564
LPAPKNLVVSRVTEDSARLSWTAPDAAFDSFTIFYIEFRYPGEAIVLTVPGSERSYDLTGLKPGTEYFVAIHGVKGGYISDPLSAIFTT

SEQ ID NO: 449 - protein, 89 aa, Artificial
  leukotoxin binding domain Luk565
LPAPKNLVVSRVTEDSARLSWTAPDAAFDSFHIFYLETWGSGEAIVLTVPGSERSYDLTGLKPGTEYFVVIHGVKGGLISSPLSAIFTT

SEQ ID NO: 450 - protein, 89 aa, Artificial
  leukotoxin binding domain Luk566
LPAPKNLVVSRVTEDSARLSWTAPDAAFDSFAIFYYEHADAGEAIVLTVPGSERSYDLTGLKPGTEYFVIIHGVKGGYISKPLSAIFTT

SEQ ID NO: 451 - protein, 89 aa, Artificial
  leukotoxin binding domain Luk567
LPAPKNLVVSRVTEDSARLSWTAPDAAFDSFAIFYQEDSDHGEAIVLTVPGSERSYDLTGLKPGTEYFVAIHGVKGGTISKPLSAIFTT

SEQ ID NO: 452 - protein, 89 aa, Artificial
  leukotoxin binding domain Luk568
LPAPKNLVVSRVTEDSARLSWTAPDAAFDSFRIFYIEEHDVGEAIVLTVPGSERSYDLTGLKPGTEYIVIIHGVKGGYISDPLSAIFTT

SEQ ID NO: 453 - protein, 89 aa, Artificial
  leukotoxin binding domain Luk569
LPAPKNLVVSRVTEDSARLSWTAPDAAFDSFTILYPETQTIGEAIVLTVPGSERSYDLTGLKPGTEYFVGIHGVKGGIISDPLSAIFTT

SEQ ID NO: 454 - protein, 89 aa, Artificial
  leukotoxin binding domain Luk570
LPAPKNLVVSRVTEDSARLSWTAPDAAFDSFIIYYGEWREHGEAIVLTVPGSERSYDLTGLKPGTEYFVLIQGVKGGQTSGPLSAIFTT

SEQ ID NO: 455 - protein, 89 aa, Artificial
  leukotoxin binding domain Luk571
LPAPKNLVVSRVTEDSARLSWTAPDAAFDSFKIFYLEPKENGEAIVLTVPGSERSYDLTGLKPGTEYFVIITGVKGGFISEPLSAIFTT

SEQ ID NO: 456 - protein, 89 aa, Artificial
  leukotoxin binding domain Luk572
LPAPKNLVVSRVTEDSARLSWTAPDAAFDSFLIHYDEWENGGEAIVLTVPGSERSYDLTGLKPGTEYWVIIIGVKGGVRSNPLSAIFTT

SEQ ID NO: 457 - protein, 89 aa, Artificial
  leukotoxin binding domain Luk575
LPAPKNLVVSRVTEDSARLSWTAPDAAFDSFPIFYVEIPQPGEAIVLTVPGSERSYDLTGLKPGTEYFVIIHGVKGGGISDPLSAIFTT

SEQ ID NO: 458 - protein, 89 aa, Artificial
  leukotoxin binding domain Luk576
LPAPKNLVVSRVTEDSARLSWTAPDAAFDSFVILYHEYWASGEAIVLTVPGSERSYDLTGLKPGTEYFVVIHGVKGGFLSDPLSAIFTT

SEQ ID NO: 459 - protein, 89 aa, Artificial
  leukotoxin binding domain Luk577
LPAPKNLVVSRVTEDSARLSWTAPDAAFDSFHIFYCEHWTSGEAIVLTVPGSERSYDLTGLKPGTEYFVAIHGVKGGEISAPLSAIFTT

SEQ ID NO: 460 - protein, 89 aa, Artificial
  leukotoxin binding domain Luk578
LPAPKNLVVSRVTEDSARLSWTAPDAAFDSFTIFYQEHLGYGEAIVLTVPGSERSYDLTGLKPGTEYVVVIHGVKGGWISSPLSAIFTT

SEQ ID NO: 461 - protein, 89 aa, Artificial
  leukotoxin binding domain Luk579
LPAPKNLVVSRVTEDSARLSWTAPDAAFDSFTIIYEETANGGEAIVLTVPGSERSYDLTGLKPGTEYFVVIHGVKGGHISSPLSAIFTT

SEQ ID NO: 462 - protein, 89 aa, Artificial
  leukotoxin binding domain Luk580
LPAPKNLVVSRVTEDSARLSWTAPDAAFDSFQIFYPETQKYGEAIVLTVPGSERSYDLTGLKPGTEYFVVIHGVKGGFISSPLSAIFTT

SEQ ID NO: 463 - protein, 89 aa, Artificial
  leukotoxin binding domain Luk581
LPAPKNLVVSRVTEDSARLSWTAPDAAFDSFVIFYGEYENGGEAIVLTVPGSERSYDLTGLKPGTEYFVIIVGVKGGFDSKPLSAIFTT

SEQ ID NO: 464 - protein, 89 aa, Artificial
  leukotoxin binding domain Luk582
LPAPKNLVVSRVTEDSARLSWTAPDAAFDSFNIFYHETVDKGEAIVLTVPGSERSYDLTGLKPGTEYFVVVSGVKGGYISDPLSAIFTT

SEQ ID NO: 465 - protein, 89 aa, Artificial
  leukotoxin binding domain Luk583
LPAPKNLVVSRVTEDSARLSWTAPDAAFDSFQIFYREESKYGEAIVLTVPGSERSYDLTGLKPGTEYFVPIHGVKGGEISDPLSAIFTT

SEQ ID NO: 466 - protein, 89 aa, Artificial
  leukotoxin binding domain Luk584
LPAPKNLVVSRVTEDSARLSWTAPDAAFDSFQIFYQEVVEWGEAIVLTVPGSERSYDLTGLKPGTEYFVVIHGVKGGWISDPLSAIFTT

SEQ ID NO: 467 - protein, 89 aa, Artificial
  leukotoxin binding domain Luk585
LPAPKNLVVSRVTEDSARLSWTAPDAAFDSFTIFYPETWIAGEAIVLTVPGSERSYDLTGLKPGTEYLVVIHGVKGGIISWPLSAIFTT

SEQ ID NO: 468 - protein, 89 aa, Artificial
  leukotoxin binding domain Luk587
LPAPKNLVVSRVTEDSARLSWTAPDAAFDSFVIPYQEYLGWGEAIVLTVPGSERSYDLTGLKPGTEYWVGIYGVKGGFISPPLSAIFTT

SEQ ID NO: 469 - protein, 89 aa, Artificial
  leukotoxin binding domain Luk588
LPAPKNLVVSRVTEDSARLSWTAPDAAFDSFAIFYYEHQVAGEAIVLTVPGSERSYDLTGLKPGTEYFVAIHGVKGGWISSPLSAIFTT

SEQ ID NO: 470 - protein, 89 aa, Artificial
  leukotoxin binding domain Luk589
LPAPKNLVVSRVTEDSARLSWTAPDAAFDSFTIIYAEEQRNGEAIVLTVPGSERSYDLTGLKPGTEYFVIIHGVKGGFISPPLSAIFTT

SEQ ID NO: 471 - protein, 89 aa, Artificial
  leukotoxin binding domain Luk590
LPAPKNLVVSRVTEDSARLSWTAPDAAFDSFSIFYLEERLTGEAIVLTVPGSERSYDLTGLKPGTEYLVVIHGVKGGVISDPLSAIFTT

SEQ ID NO: 472 - protein, 89 aa, Artificial
  leukotoxin binding domain Luk592
LPAPKNLVVSRVTEDSARLSWTAPDAAFDSFTIFYYEAVHQGEAIVLTVPGSERSYDLTGLKPGTEYFVVIHGVKGGNISVPLSAIFTT

SEQ ID NO: 473 - protein, 89 aa, Artificial
  leukotoxin binding domain Luk593
LPAPKNLVVSRVTEDSARLSWTAPDAAFDSFAIFYVELVWKGEAIVLTVPGSERSYDLTGLKPGTEYFVVIHGVKGGYISDPLSAIFTT

SEQ ID NO: 474 - protein, 89 aa, Artificial
  leukotoxin binding domain Luk594
LPAPKNLVVSRVTEDSARLSWTAPDAAFDSFVIHYGEYENGGEAIVLTVPGSERSYDLTGLKPGTEYFVAIHGVKGGFISDPLSAIFTT

SEQ ID NO: 475 - protein, 89 aa, Artificial
  leukotoxin binding domain Luk595
LPAPKNLVVSRVTEDSARLSWTAPDAAFDSFTIIYFETKAYGEAIVLTVPGSERSYDLTGLKPGTEYWVIIHGVKGGYISVPLSAIFTT

SEQ ID NO: 476 - protein, 89 aa, Artificial
  leukotoxin binding domain Luk596
LPAPKNLVVSRVTEDSARLSWTAPDAAFDSFVIFYDEEWSKGEAIVLTVPGSERSYDLTGLKPGTEYAVFIYGVKGGAISEPLSAIFTT

SEQ ID NO: 477 - protein, 89 aa, Artificial
  leukotoxin binding domain Luk597
LPAPKNLVVSRVTEDSARLSWTAPDAAFDSFYIHYLETDPGGEAIVLTVPGSERSYDLTGLKPGTEYFVSIYGVKGGWISPPLSAIFTT

SEQ ID NO: 478 - protein, 89 aa, Artificial
  leukotoxin binding domain Luk598
LPAPKNLVVSRVTEDSARLSWTAPDAAFDSFVIFYDEDRPQGEAIVLTVPGSERSYDLTGLKPGTEYFVVIHGVKGGYLSIPLSAIFTT

SEQ ID NO: 479 - protein, 89 aa, Artificial
  leukotoxin binding domain Luk599
LPAPKNLVVSRVTEDSARLSWTAPDAAFDSFYIFYREETPHGEAIVLTVPGSERSYDLTGLKPGTEYWVLILGVKGGGISEPLSAIFTT

SEQ ID NO: 480 - protein, 89 aa, Artificial
  leukotoxin binding domain Luk601
LPAPKNLVVSRVTEDSARLSWTAPDAAFDSFTIFYIEDNKVGEAIVLTVPGSVRSYDLTGLKPGTEYFVVIHGVKGGIISEPLSAIFTT

SEQ ID NO: 481 - protein, 89 aa, Artificial
  leukotoxin binding domain Luk602
LPAPKNLVVSRVTEDSARLSWTAPDAAFDSFVIFYQELNRDGEAIVLTVPGSERSYDLTGLKPGTEYLVIIHGVKGGFISPPLSAIFTT

SEQ ID NO: 482 - protein, 89 aa, Artificial
  leukotoxin binding domain Luk603
LPAPKNLVVSRVTEDSARLSWTAPDAAFDSFHIFYLEFWYRGEAIVLTVPGSERSYDLTGLKPGTEYNVIIHGVKGGWISEPLSAIFTT

SEQ ID NO: 483 - protein, 89 aa, Artificial
  leukotoxin binding domain Luk604
LPAPKNLVVSRVTEDSARLSWTAPDAAFDSFQIFYGEWPQEGEAIVLTVPGSERSYDLTGLKPGTEYWVVILGVKGGQASPPLSAIFTT

SEQ ID NO: 484 - protein, 89 aa, Artificial
  leukotoxin binding domain Luk605
LPAPKNLVVSRVTEDSARLSWTAPDAAFDSFRIHYLEHAARGEAIVLTVPGSERSYDLTGLKPGTEYFVAIYGVKGGYISFPLSAIFTT

SEQ ID NO: 485 - protein, 89 aa, Artificial
  leukotoxin binding domain Luk606
LPAPKNLVVSRVTEDSARLSWTAPDAAFDSFTIHYLESYPRGEAIVLTVPGSERSYDLTGLKPGTEYFVAIYGVKGGYLSPPLSAIFTT

SEQ ID NO: 486 - protein, 89 aa, Artificial
  leukotoxin binding domain Luk607
LPAPKNLVVSRVTEDSARLSWTAPDAAFDSFQIFYHEWVPWGEAIVLTVPGSERSYDLTGLKPGTEYFVVIHGVKGGTISFPLSAIFTT

SEQ ID NO: 487 - protein, 89 aa, Artificial
  leukotoxin binding domain Luk608
LPAPKNLVVSRVTEDSARLSWTAPDAAFDSFNIFYGEYENGGEAIVLTVPGSERSYDLTGLKPGTEYFVFIIGVKGGPDSLPLSAIFTT

SEQ ID NO: 488 - protein, 89 aa, Artificial
  leukotoxin binding domain Luk609
LPAPKNLVVSRVTEDSARLSWTAPDAAFDSFDIRYWEGPGYGEAIVLTVPGSERSYDLTGLKPGTEYRVRIVGVKGGKRSEPLSAIFTT

SEQ ID NO: 489 - protein, 89 aa, Artificial
  leukotoxin binding domain Luk610
LPAPKNLVVSRVTEDSARLSWTAPDAAFDSFFIYYGEYDPVGEAIVLTVPGSERSYDLTGLKPGTEYFVIIQGVKGGQASGPLSAIFTT

SEQ ID NO: 490 - protein, 89 aa, Artificial
  leukotoxin binding domain Luk611
LPAPKNLVVSRVTEDSARLSWTAPDAAFDSFHIAYAEFWRYGEAIVLTVPGSERSYDLTGLKPGTEYWVNIAGVKGGEWSKPLSAIFTT

SEQ ID NO: 491 - protein, 89 aa, Artificial
  leukotoxin binding domain Luk612
LPAPKNLVVSRVTEDSARLSWTAPDAAFDSFTIFYQEESKYGEAIVLTVPGSERSYDLTGLKPGTEYFVVIHGVKGGAISQPLSAIFTT

SEQ ID NO: 492 - protein, 89 aa, Artificial
  leukotoxin binding domain Luk613
LPAPKNLVVSRVTEDSARLSWTAPDAAFDSFNIFYIETDKPGEAIVLTVPGSERSYDLTGLKPGTEYFVAIHGVKGGFISEPLSAIFTT

SEQ ID NO: 493 - protein, 89 aa, Artificial
  leukotoxin binding domain Luk614
LPAPKNLVVSRVTEDSARLSWTAPDAAFDSFQIFYTEPVGHGEAIVLTVPGSERSYDLTGLKPGTEYFVAIHGVKGGTISPPLSAIFTT

SEQ ID NO: 494 - protein, 89 aa, Artificial
  leukotoxin binding domain Luk615
LPAPKNLVVSRVTEDSARLSWTAPDAAFDSFHIFYIEHRLQGEAIVLTVPGSERSYDLTGLKPGTEYLVLIHGVKGGFISPPLSAIFTT

SEQ ID NO: 495 - protein, 89 aa, Artificial
  leukotoxin binding domain Luk616
LPAPKNLVVSRVTEDSARLSWTAPDAAFDSFHIFYHEGLKSGEAIVLTVPGSERSYDLTGLKPGTEYLVVIHGVKGGTISNPLSAIFTT

SEQ ID NO: 496 - protein, 89 aa, Artificial
  leukotoxin binding domain Luk617
LPAPKNLVVSRVTEDSARLSWTAPDAAFDSFVIFYHETRVTGEAIVLTVPGSERSYDLTGLKPGTEYLVVIHGVKGGYISEPLSAIFTT

SEQ ID NO: 497 - protein, 89 aa, Artificial
  leukotoxin binding domain Luk618
LPAPKNLVVSRVTEDSARLSWTAPDAAFDSFSIFYQEAVEGGEAIVLTVPGSERSYDLTGLKPGTEYFVPIHGVKGGWISQPLSAIFTT

SEQ ID NO: 498 - protein, 89 aa, Artificial
  leukotoxin binding domain Luk619
LPAPKNLVVSRVTEDSARLSWTAPDAAFDSFQILYVEEFTRGEAIVLTVPGSERSYDLTGLKPGTEYVVIIHGVKGGYISKPLSAIFTT

SEQ ID NO: 499 - protein, 87 aa, Artificial
  leukotoxin binding domain Luk620
LPAPKNLVVSRVTEDSARLSWTAPDAAFDSFTYIEALGFGEAIVLTVPGSERSYDLTGLKPGTEYFVAIYGVKGGYISEPLSAIFTT

SEQ ID NO: 500 - protein, 89 aa, Artificial
  leukotoxin binding domain Luk621
LPAPKNLVVSRVTEDSARLSWTAPDAAFDSFVIFYLEHWNPGEAIVLTVPGSERSYDLTGLKPGTEYLVPIHGVKGGSISPPLSAIFTT

SEQ ID NO: 501 - protein, 89 aa, Artificial
  leukotoxin binding domain Luk622
LPAPKNLVVSRVTEDSARLSWTAPDAAFDSFTIFYVEWEVVGEAIVLTVPGSERSYDLTGLKPGTEYFVVIHGVKGGVISNPLSAIFTT

SEQ ID NO: 502 - protein, 89 aa, Artificial
  leukotoxin binding domain Luk623
LPAPKNLVVSRVTEDSARLSWTAPDAAFDSFRIFYLEESKNGEAIVLTVPGSERSYDLTGLKPGTEYQVVIHGVKGGVISPPLSAIFTT

SEQ ID NO: 503 - protein, 89 aa, Artificial
  leukotoxin binding domain Luk624
LPAPKNLVVSRVTEDSARLSWTAPDAAFDSFAIFYNEDHKSGEAIVLTVPGSERSYDLTGLKPGTEYLVVIHGVKGGYISKPLSAIFTT

SEQ ID NO: 504 - protein, 88 aa, Artificial
  leukotoxin binding domain Luk625
LPAPKNLVVSRVPEDSARLSWTAPDAAFDSFLIDYQEWHEGEAIHLLVPGSERSYDLTGLKPGTEYAVIIVGVKGGKGSHPLSAIFTT

SEQ ID NO: 505 - protein, 89 aa, Artificial
  leukotoxin binding domain Luk626
LPAPKNLVVSRVTEDSARLSWTAPYAAFDSFWIGYYETTIPGEAIDLVVPGSERSYDLTGLKPGTEYGVGIDGVKGGRYSHPLSAIFTT

SEQ ID NO: 506 - protein, 89 aa, Artificial
  leukotoxin binding domain Luk627
LPAPKNLVVSRVTEDSARLSWTAPDAAFDSFAIFYKEEAIPGEAIALIVPGSERSYDLTGLKPGTEYFVPIHGVKGGYISTPLSAIFTT

SEQ ID NO: 507 - protein, 89 aa, Artificial
  leukotoxin binding domain Luk628
LPAPKNLVVSRVTEDSARLSWTAPDAAFDSFLIDYTELHNWGEAIHLFVPGSERSYDLTGLKPGTEYTVLIVGVKGGTGSIPLSAIFTT

SEQ ID NO: 508 - protein, 89 aa, Artificial
  leukotoxin binding domain Luk629
LPAPKNLVVSRVTEDSARLSWTAPDAAFDSFYITYEEEWWTGEAIFLDVPGSERSYDLTGLKPGTEYLVTIKGVKGGPWSQPLSAIFTT

SEQ ID NO: 509 - protein, 89 aa, Artificial
  leukotoxin binding domain Luk630
LPAPKNLVVSRVTEDSARLSWTAPDAAFDSFAIWYHEWGPVGEAILLYVPGSERSYDLTGLKPGTEYPVAIHGVKGGGTSHPLSAIFTT

SEQ ID NO: 510 - protein, 89 aa, Artificial
  leukotoxin binding domain Luk631
LPAPKNLVVSRVTEDSARLSWTAPDAAFDSFRIFYEELRYKGEAIWLFVPGSERSYDLTGLKPGTEYHVHIWGVKGGYFSRPLSAIFTT

SEQ ID NO: 511 - protein, 89 aa, Artificial
  leukotoxin binding domain Luk632
LPAPKNLVVSRVTEDSARLSWTAPDAAFDSFIIDYWEQWNTGEAIHLYVPGSERSYDLTGLKPGTEYSVYIVGVKGGYASWPLSAIFTT

SEQ ID NO: 512 - protein, 89 aa, Artificial
  leukotoxin binding domain Luk633
LPAPKNLVVSRVTEDSARLSWTAPDAAFDSFWIGYDENHLYGEAIDLVVPGSERSYDLTGLKPGTEYTVSIAGVKGGLESFPLSAIFTT

SEQ ID NO: 513 - protein, 89 aa, Artificial
  leukotoxin binding domain Luk634
LPAPKNLVVSRVTEDSARLSWTAPEAAFDSFHISYWEFPLGGEAIGLWVPGSERSYDLTGLKPGTEYFVIIAGVKGGEFSNPLSAIFTT

SEQ ID NO: 514 - protein, 89 aa, Artificial
  leukotoxin binding domain Luk635
LPAPKNLVVSRVTEDSARLSWTAPDAAFDSFIIEYHEWFAKGEAIGLVVPGSERSYDLTGLKPGTEYSVIIVGVKGGAYSFPLSAIFTT

SEQ ID NO: 515 - protein, 89 aa, Artificial
  leukotoxin binding domain Luk636
LPAPKNLVVSRVTEDSARLSWTAPDAAFDSFLIDYWEGEFDGEAIHLFVPGSERSYDLTGLKPGTEYDVFIVGVKGGHGSDPLSAIFTT

SEQ ID NO: 516 - protein, 89 aa, Artificial
  leukotoxin binding domain Luk637
LPAPKNLVVSRVTEDSARLSWTAPDAAFDSFQIPYYELDSVGEAIVLTVPGSERSYDLTGLKPGTEYFVGIYGVKGGYISPPLSAIFTT

SEQ ID NO: 517 - protein, 89 aa, Artificial
  leukotoxin binding domain Luk638
LPAPKNLVVSRVTEDSARLSWTAPDAAFDSFYIGYGEYDPTGEAIVLTVPGSERSYDLTGLKPGTEYWVLISGVKGGYYSDPLSAIFTT

SEQ ID NO: 518 - protein, 89 aa, Artificial
  leukotoxin binding domain Luk639
LPAPKNLVVSRVTEDSARLSWTAPDAAFDSFVIYYLESVARGEAIVLTVPGSERSYDLTGLKPGTEYFVPIYGVKGGYISYPLSAIFTT

SEQ ID NO: 519 - protein, 89 aa, Artificial
  leukotoxin binding domain Luk640
LPAPKNLVVSRVTEDSARLSWTAPDAAFDSFTIPYWESYYSGEAIVLTVPGSERSYDLTGLKPGTEYVVAIYGVKGGYISSPLSAIFTT

SEQ ID NO: 520 - protein, 89 aa, Artificial
  leukotoxin binding domain Luk641
LPAPKNLVVSRVTEDSARLSWTAPDAAFDSFGIYYGEYHSGGEAIVLTVPGSERSYDLTGLKPGTEYFVLIDGVKGGLYSGPLSAIFTT

SEQ ID NO: 521 - protein, 89 aa, Artificial
  leukotoxin binding domain Luk642
LPAPKNLVVSRVTEDSARLSWTAPDAAFDSFYIVYAEYYWYGEAIVLTVPGSERSYDLTGLKPGTEYYVYIAGVKGGYGSDPLSAIFTT

SEQ ID NO: 522 - protein, 89 aa, Artificial
  leukotoxin binding domain Luk643
LPAPKNLVVSRVTEDSARLSWTAPDAAFDSFTIPYYESNLGGEAIVLTVPGSERSYDLTGLKPGTEYWVGIYGVKGGHISSPLSAIFTT

SEQ ID NO: 523 - protein, 89 aa, Artificial
  leukotoxin binding domain Luk644
LPAPKNLVVSRVTEDSARLSWTAPDAAFDSFTILYYELIDSGEAIVLTVPGSERSYDLTGLKPGTEYFVGIYGVKGGYISLPLSAIFTT

SEQ ID NO: 524 - protein, 89 aa, Artificial
  leukotoxin binding domain Luk645
LPAPKNLVVSRVTEDSARLSWTAPDAAFDSFWISYGEYWPSGEAIVLTVPGSERSYDLTGLKPGTEYFVLIRGVKGGDYSNPLSAIFTT

SEQ ID NO: 525 - protein, 89 aa, Artificial
  leukotoxin binding domain Luk646
LPAPKNLVVSRVTEDSARLSWTAPDAAFDSFRIFYGEYDGGGEAIVLTVPGSERSYDLTGLKPGTEYGVYIYGVKGGYISQPLSAIFTT

SEQ ID NO: 526 - protein, 89 aa, Artificial
  leukotoxin binding domain Luk647
LPAPKNLVVSRVTEDSARLSWTAPDAAFDSFSIYYGEWDPTGEAIVLTVPGSERSYDLTGLKPGTEYWVLIVGVKGGSTSAPLSAIFTT

SEQ ID NO: 527 - protein, 89 aa, Artificial
  leukotoxin binding domain Luk648
LPAPKNLVVSRVTEDSARLSWTAPDAAFDSFWIGYEEYYLVGEAIVLTVPGSERSYDLTGLKPGTEYLVWIKGVKGGYVGRPLSAIFTT

SEQ ID NO: 528 - protein, 89 aa, Artificial
  leukotoxin binding domain Luk649
LPAPKNLVVSRVTEDSARLSWTAPDAAFDSFGIAYSERVRYGEAIVLTVPGSERSYDLTGLKPGTEYWVGISGVKGGPYSEPLSAIFTT

SEQ ID NO: 529 - protein, 89 aa, Artificial
  leukotoxin binding domain Luk650
LPAPKNLVVSRVTEDSARLSWTAPDAAFDSFTIHYYESYTVGEAIVLTVPGSERSYDLTGLKPGTEYWVGIYGVKGGYISEPLSAIFTT

SEQ ID NO: 530 - protein, 97 aa, Artificial
  leukotoxin binding domain Luk651
LPAPKNLVLSRVTEDSARLSWAQATYYQFDSFLIQYQESEKVGEAIVLTVPGSERSYDLTGLKPGTEYTVSIYGVLEVIPKLRYKVYSNPLSAIFTT

SEQ ID NO: 531 - protein, 96 aa, Artificial
  leukotoxin binding domain Luk652
LPAPKNLVVSRVTEDSARLSWSEVEDIPFDSFLIQYQESEKVGEAIVLTVPGSERSYDLTGLKPGTEYTVSIYGVLHYNRGQHPWHSNPLSAIFTT

SEQ ID NO: 532 - protein, 97 aa, Artificial
  leukotoxin binding domain Luk653
LPAPKNLVVSRVTEDSARLSWNLEVAFYFDSFLIQYQESEKVGEAIVLTVPGSERSYDLTGLKPGTEYTVSIYGVEHLDEVWWTANLSNPLSAIFTT

SEQ ID NO: 533 - protein, 93 aa, Artificial
  leukotoxin binding domain Luk654
LPAPKNLVVSRVTEDSARLSWSHFPNDWFDSFLIQYQESEKVGEAIVLTVPGSERSYDLTGLKPGTEYTVSIYGVHYWQFDIQSNPLSAIFTT

SEQ ID NO: 534 - protein, 97 aa, Artificial
  leukotoxin binding domain Luk655
LPAPKNLVVCRVTEDSARLSWRTYTSDAGFDSFLIQYQESEKVGEAIVLTVPGSERSYDLTGLKPGTEYTVSIYGVHEHAHIQYWHWSNPLSAIFTT

SEQ ID NO: 535 - protein, 98 aa, Artificial
  leukotoxin binding domain Luk656
LPAPKNLVVSRVTEDSARLSWKREQWANYFDSFLIQYQESEKVGEAIVLTVPGSERSYDLTGLKPGTEYTVSIYGVWEHLYKELWSYTSNPLSAIFTT

SEQ ID NO: 536 - protein, 95 aa, Artificial
  leukotoxin binding domain Luk657
LPAPKNLVVSRVTEDSARLSWSELEARTHFDSFLIQYQESEKVSEAIVLTVPGSERSYDLTGLKPGTEYTVSIYGVAQQLVAWRGSNPLSAIFTT

SEQ ID NO: 537 - protein, 94 aa, Artificial
  leukotoxin binding domain Luk658
LPAPKNLVVSRVTEDSARLSWKRARLDLPFDSFLIQYQESEKVGEAIVLTVPGSERSYDLTGLKPGTEYTVSIYGVDAWIPTVGSNPLSAIFTT

SEQ ID NO: 538 - protein, 97 aa, Artificial
  leukotoxin binding domain Luk659
LPAPKNLVVSRVTEDSARLSWINYWVLNYFDSFLIQYQESEKVGEAIVLTVPGSERSYDLTGLKPGTEYTVSIYGVEVWPQDHEWIDSNPLSAIFTT

SEQ ID NO: 539 - protein, 93 aa, Artificial
  leukotoxin binding domain Luk660
LPAPKNLVVSRVTEDSARLSWYREVDFTTFDSFLIQYQESEKVGEAIVLTVPGSERSYDLTGLKPGTEYTVSIYGVSSYYILHSNPLSAIFTT

SEQ ID NO: 540 - protein, 89 aa, Artificial
  leukotoxin binding domain Luk661
LPAPKNLVVSRVTEDSARLSWTAPDAAFDSFLITYREQIFAGEVIVLTVPGSERSYDLTGLKPGTEYPVCIYGVKGGPISDPLSAIFTT

SEQ ID NO: 541 - protein, 74 aa, Artificial
  leukotoxin binding domain Luk662
LPAPKNLVVSRVTEDSARLSWTAPDAAFDSFVINYREVINEGEAIILHVPGSERSYRPERSETGYRIHRHHSWC

SEQ ID NO: 542 - protein, 94 aa, Artificial
  leukotoxin binding domain Luk663
LPAPKNLVVSRVTEDSARLSWVVHNHLAFDSFLIQYQESEKVGEAIVLTVPGSERSYDLTGLKPGTEYTVSIYGVEPYVYAQYESNPLSAIFTT

SEQ ID NO: 543 - protein, 93 aa, Artificial
  leukotoxin binding domain Luk664
LPAPKNLVVSRVTEDSARLSWKRKSGAPFDSFLIQYQESEKVGEAIVLTVPGSERSYDLTGLKPGTEYTVSIYGVHGWDPGSDSNPLSAIFTT

SEQ ID NO: 544 - protein, 92 aa, Artificial
  leukotoxin binding domain Luk665
LPAPKNLVVSRVTEDSARLSWWHVRGHDFDSFLIQYQESEKVGEAIVLTVPGSERSYDLTGLKPGTEYTVSIYGVVWLPTTDSNPLSAIFTT

SEQ ID NO: 545 - protein, 92 aa, Artificial
  leukotoxin binding domain Luk666
LPAPKNLVVSRVTEDSARLSWSPDRARFDSFLIQYQESEKVGEAIVLTVPGSERSYDLTGLKPGTEYTVSIYGVWSWDNDDASNPLSAIFTT

SEQ ID NO: 546 - protein, 96 aa, Artificial
  leukotoxin binding domain Luk667
LPAPKNLVVSRVTEDSARLSWFAGLQLFDSFLIQYQESEKVGEAIVLTVPGSERSYDLTGLKPGTEYTVSIYGVDWTVEEQSYHLWSNPLSAIFTT

SEQ ID NO: 547 - protein, 95 aa, Artificial
  leukotoxin binding domain Luk668
LPAPKNLVVSRVTEDSARLSWTIPHYTFDSFLIQYQESEKVGEAIVLTVPGSERSYDLTGLKPGTEYTVSIYGVPGKYIEPRWHFSNPLSAIFTT

SEQ ID NO: 548 - protein, 92 aa, Artificial
  leukotoxin binding domain Luk669
LPAPKNLVVSRVTEDSARLSWKRYSWLFDSFLIQYQESEKVGEAIVLTVPGSERSYDLTGLKPGTEYTVSIYGVLTWDPNDPSNPLSAIFTT

SEQ ID NO: 549 - protein, 97 aa, Artificial
  leukotoxin binding domain Luk670
LPAPKNLVVSRVTEDSARLSWKTIVTTIFDSFLIQYQESEKVGEAIVLTVPGSERSYDLTGLKPGTEYTVSIYGVDHRGFPFWQYWSSNPLSAIFTT

SEQ ID NO: 550 - protein, 92 aa, Artificial
  leukotoxin binding domain Luk671
LPAPKNLVVSRVTEDSARLSWYARRIYFDSFLIQYQESEKVGEAIVLTVPGSERSYDLTGLKPGTEYTVSIYGVETPNPYYDSNPLSAIFTT

SEQ ID NO: 551 - protein, 96 aa, Artificial
  leukotoxin binding domain Luk672
LPAPKNLVVSRVTEDSARLSWNLEQSTFDSFLIQYQESEKVGEAIVLTVPGSERSYDLTGLKPGTEYTVSIYGVTTYRITVPVRDHSNPLSAIFTT

SEQ ID NO: 552 - protein, 94 aa, Artificial
  leukotoxin binding domain Luk673
LPAPKNLVVSRVTEDSARLSWRAAGTGFDSFLIQYQESEKVGEAIVLTVPGSERSYDLTGLKPGTEYTVSIYGVNWQPDYWTWPSNPLSAIFTT

SEQ ID NO: 553 - protein, 93 aa, Artificial
  leukotoxin binding domain Luk674
LPAPKNLVVSRVTEDSARLSWPISHLSFDSFLIQYQESEKVGEAIVLTVPGSERSYDLTGLKPGTEYTVSIYGVWHQTVGRWFSNPLSAIFTT

SEQ ID NO: 554 - protein, 93 aa, Artificial
  leukotoxin binding domain Luk675
LPAPKNLVVSRVTEDSARLSWVRKKVNRFDSFLIQYQESEKVGEAIVLTVPGSERSYDLTGLKPGTEYTVSIYGVRNWKPNDPSNPLSAIFTT

SEQ ID NO: 555 - protein, 93 aa, Artificial
  leukotoxin binding domain Luk676
LPAPKNLVVSRVTEDSARLSWVSATQHPFDSFLIQYQESEKVGEAIVLTVPGSERSYDLTGLKPGTEYTVSIYGVDNWDPTDPSNPLSAIFTT

SEQ ID NO: 556 - protein, 92 aa, Artificial
  leukotoxin binding domain Luk677
LPAPKNLVVSRVTEDSARLSWPIALRDFDSFLIQYQESEKVGEAIVLTVPGSERSYDLTGLKPGTEYTVSIYGVISWDPTDPSNPLSAIFTT

SEQ ID NO: 557 - protein, 98 aa, Artificial
  leukotoxin binding domain Luk678
LPAPKNLVVSRVTEDSARLSWWDAEWFAPHFDSFLIQYQESEKVGEAIVLTVPGSERSYDLTGLKPGTEYTVSIYGVGLLKWPNYAVLSNPLSAIFTT

SEQ ID NO: 558 - protein, 95 aa, Artificial
  leukotoxin binding domain Luk679
LPAPKNLVVSRVTEDSARLSWPNNQRYYQPFDSFLIQYQESEKVGEAIVLTVPGSERSYDLTGLKPGTEYTVSIYGVLSWNPHHWSNPLSAIFTT

SEQ ID NO: 559 - protein, 98 aa, Artificial
  leukotoxin binding domain Luk680
LPAPKNLVVSRVTEDSARLSWYDARVTDEFFDSFLIQYQESEKVGEAIVLTVPGSERSYDLTGLKPGTEYTVSIYGVDDLLTNHLLAISNPLSAIFTT

SEQ ID NO: 560 - protein, 94 aa, Artificial
  leukotoxin binding domain Luk681
LPAPKNLVVSRVTEDSARLSWKKRNTLKIFDSFLIQYQESEKVGEAIVLTVPGSERSYDLTGLKPGTEYTVSIYGVETWDPNDWSNPLSAIFTT

SEQ ID NO: 561 - protein, 94 aa, Artificial
  leukotoxin binding domain Luk682
LPAPKNLVVSRVTEDSARLSWLNRVKPNDFDSFLIQYQESEKVGEAIVLTVPGSERSYDLTGLKPGTEYTVSIYGVITWHPGHWSNPLSAIFTT

SEQ ID NO: 562 - protein, 94 aa, Artificial
  leukotoxin binding domain Luk683
LPAPKNLVVSRVTEDSARLSWLTVRFTKFEFDSFLIQYQESEKVGEAIVLIVPGSERSYDLTGLKPGTEYTVSIYGVRSSKPRASNPLSAIFTT

SEQ ID NO: 563 - protein, 95 aa, Artificial
  leukotoxin binding domain Luk684
LPAPKNLVVSRVTEDSARLSWPNYRKVVSVFDSFLIQYQESEKVGEAIVLTVPGSERSYDLTGLKPGTEYTVSIYGVHTWHPGHYSNPLSAIFTT

SEQ ID NO: 564 - protein, 95 aa, Artificial
  leukotoxin binding domain Luk685
LPAPKNLVVSRVTEDSARLSWGNRQQVRSAFDSFLIQYQESEKVGEAIVLTVPGSERSYDLTGLKPGTEYTVSIYGVVGWHPNHPSNPLSAIFTT

SEQ ID NO: 565 - protein, 57 aa, Artificial
  leukotoxin binding domain Luk686
LPARKTWLFLVLPKTLRVCLGPRRTRRSTLFGLRTQRLLSGGKRLACWCRVLNVLTT

SEQ ID NO: 566 - protein, 46 aa, Artificial
  leukotoxin binding domain Luk687
LPARKTWLFLVLPKTLRVCLGPRRTRRSTLSGLHTQRRHPGVKRSA

SEQ ID NO: 567 - protein, 89 aa, Artificial
  leukotoxin binding domain Luk688
LPAPKNLVVSRVTEDSARLSWTAPDAAFDSFGIEGGEYYYVGEAIVLTVPGSERSYDLTGLKPGTEYGVPIGGVKGGPNSHPLSAIFTT

SEQ ID NO: 568 - protein, 95 aa, Artificial
  leukotoxin binding domain Luk689
LPAPKNLVVSRVTEDSARLSWWFYLTSWFAFDSFLIQYQESEKVGEAIVLTVPGSERSYDLTGLKPGTEYTVSIYGVLKVDPHVRSNPLSAIFTT

SEQ ID NO: 569 - protein, 97 aa, Artificial
  leukotoxin binding domain Luk690
LPAPKNLVVSRVTEDSARLSWYHVNFGFFDSFLIQYQESEKVGEAIVLTVPGSERSYDLTGLKPGTEYTVSIYGVYEDYPVIIFNNRSNPLSAIFTT

SEQ ID NO: 570 - protein, 94 aa, Artificial
  leukotoxin binding domain Luk691
LPAPKNLVVSRVTEDSARLSWEDIKNKRFDSFLIQYQESEKVGEAIVLTVPGSERSYDLTGLKPGTEYTVSIYGVRGLANPFRVSNPLSAIFTT

SEQ ID NO: 571 - protein, 96 aa, Artificial
  leukotoxin binding domain Luk692
LPAPKNLVVSRVTEDSARLSWWRYGPWFHFDSFLIQYQESEKVGEAIVLTVPGSERSYDLTGLKPGTEYTVSIYGVRTHVRPPQWVSNPLSAIFTT

SEQ ID NO: 572 - protein, 96 aa, Artificial
  leukotoxin binding domain Luk693
LPAPKAAVVSRVTEDSARLSWWRYGPWFHFDSFLIQYQESEKVGEAIVLTVPGSERSYDLTGLKPGTEYTVSIYGVRTHVRPPQWVSNPLSAIFTT

SEQ ID NO: 573 - protein, 22 aa, Artificial
  leukotoxin binding domain Luk694
LPAPKNLGCFSCYRRLCPSVLD

SEQ ID NO: 574 - protein, 98 aa, Artificial
  leukotoxin binding domain Luk695
LPAPKNLVVSRVTEDSARLSWLNWEQYITFDSFLIQYQESEKVGEAIVLTVPGSERSYDLTGLKPGTEYTVSIYGVWIIRDRSHWLNPSNPLSAIFTT

SEQ ID NO: 575 - protein, 34 aa, Artificial
  leukotoxin binding domain Luk696
LPAPKNLWLFLVLPKTLPVCLGGVMARGSTSTLS

SEQ ID NO: 576 - protein, 95 aa, Artificial
  leukotoxin binding domain Luk697
LPAPKNLVVSRVTEDSARLSWERFGPWFHFDSFLIQYQESEKVGEAIVLTVPGSERSYDLTGLKPGTEYTVSIYGVKTQPEQEFKSNPLSAIFTT

SEQ ID NO: 577 - protein, 44 aa, Artificial
  leukotoxin binding domain Luk698
LPAPKNPGCFSCYRRLCPSVLVALWPVVPLRLFPDPVPGIRKSW

SEQ ID NO: 578 - protein, 94 aa, Artificial
  leukotoxin binding domain Luk699
LPAPKNLVVSRVTEDSARLSWWRYGPWFHFDSFLIQYQESEKVGEAIVLTVPGSERSYDLTGLKPGTEYTVSIYGVKQHHSLFHSNPLSAIFTT

SEQ ID NO: 579 - protein, 93 aa, Artificial
  leukotoxin binding domain Luk700
LPAPKNLVVSRVTEDSARLSWNQQLNYQYFDSFLIQYQESEKVGEAIVLTVPGSERSYDLTGLKPGTEYTVSIYGVWYRWWSGSNPLSAIFTT

SEQ ID NO: 580 - protein, 97 aa, Artificial
  leukotoxin binding domain Luk701
LPAPKNLVVSRVTEDSARLSWWRYGPWFHFDSFLIQYQESEKVGEAIVLTVPGSERSYDLTGLKPGTEYTVSIYGVRTHNNQPGHYTSNPLSAIFTT

SEQ ID NO: 581 - protein, 44 aa, Artificial
  leukotoxin binding domain Luk702
LPAPTKNGCFSCYRRLCPSVLVALWPVVPLRLFPDPVPGIRKSW

SEQ ID NO: 582 - protein, 96 aa, Artificial
  leukotoxin binding domain Luk703
LPAPKALVVSRVTEDSARLSWWRYGPWFHFDSFLIQYQESEKVGEAIVLTVPGSERSYDLTGLKPGTEYTVSIYGVRTHVRPPQWVSNPLSAIFTT

SEQ ID NO: 583 - protein, 89 aa, Artificial
  leukotoxin binding domain Luk704
LPAPKNLVVSRVTEDSARLSWTAPDAAFDSFPILYQERWWKGEAIVLTVPGSERSYDLTGLKPGTEYGVPITGVKGGGVSFPLSAIFTT

SEQ ID NO: 584 - protein, 89 aa, Artificial
  leukotoxin binding domain Luk705
LPAPKNLVVSRVTEDSARLSWTAPDAAFDSFHIWYRESWYFGEAIVLTVPGSERSYDLTGLKPGTEYYVVIRGVKGGSLSWPLSAIFTT

SEQ ID NO: 585 - protein, 89 aa, Artificial
  leukotoxin binding domain Luk706
LPAPKNLVVSRVTEDSARLSWTAPDAAFDSFPISYYEQPRRGEAIWLFVPGSERSYDLTGLKPGTEYTVYITGVKGGTWSFPLTATFTT

SEQ ID NO: 586 - protein, 89 aa, Artificial
  leukotoxin binding domain Luk707
LPAPKNLVVSRVTEDSARLSWTAPDAAFDSFGIEYYETKTKGEAINLFVPGSERSYDLTGLKPGTEYYVIILGVKGGEPSSPLVAPFTT

SEQ ID NO: 587 - protein, 95 aa, Artificial
  leukotoxin binding domain Luk708
LPAPKNLVVSRVTEDSARLSWKDVGEWKFDSFLIQYQESEKVGEAIVLTVPGSERSYDLTGLKPGTEYTVSIYGVHQLTITYSPTSNPLSAIFTT

SEQ ID NO: 588 - protein, 96 aa, Artificial
  leukotoxin binding domain Luk709
LPAPKNLVVSRVTEDSARLSWKRSYHPNFDSFLIQYQESEKVGEAIVLTVPGSERSYDLTGLKPGTEYTVSIYGVIDVPTVYHPGRSNPLSAIFTT

SEQ ID NO: 589 - protein, 95 aa, Artificial
  leukotoxin binding domain Luk710
LPAPKNLVVSRVTEDSARLSWLKKVSKFDSFLIQYQESEKVGEAIVLTVPGSERSYDLTGLKPGTEYTVSIYGVGEFPDRIYWGASNPLSAIFTT

SEQ ID NO: 590 - protein, 96 aa, Artificial
  leukotoxin binding domain Luk711
LPAPKNLVVSRVTEDSARLSWYYWVQTIFDSFLIQYQESEKVGEAIVLTVPGSERSYDLTGLKPGTEYTVSIYGVGNLPDIFYKLPSNPLSAIFTT

SEQ ID NO: 591 - protein, 91 aa, Artificial
  leukotoxin binding domain Luk712
LPAPKNLVVSRVTEDSARLSWSKKLENFDSFLIQYQESEKVGEAIVLTVPGSERSYDLTGLKPGTEYTVSIYGVYHTHLIFSNPLSAIFTT

SEQ ID NO: 592 - protein, 92 aa, Artificial
  leukotoxin binding domain Luk713
LPAPKNLVVSRVTEDSARLSWHDLTIWPFDSFLIQYQESEKVGEAIVLTVPGSERSYDLTGLKPGTEYTVSIYGVVIEFEAWSNPLSAIFTT

SEQ ID NO: 593 - protein, 97 aa, Artificial
  leukotoxin binding domain Luk714
LPAPKNLVVSRVTEDSARLSWFPWTEWSAFDSFLIQYQESEKVGEAIVLTVPGSERSYDLTGLKPGTEYTVSIYGVENWLVLATATWSNPLSAIFTT

SEQ ID NO: 594 - protein, 97 aa, Artificial
  leukotoxin binding domain Luk715
LPAPKNLVVSRVTEDSARLSWVEWWIRPIEFDSFLIQYQESEKVGEAIVLTVPGSERSYDLTGLKPGTEYTVSIYGVWQQLYVEILISNPLSAIFTT

SEQ ID NO: 595 - protein, 95 aa, Artificial
  leukotoxin binding domain Luk716
LPAPKNLVVSRVTEDSARLSWSSQRTLPREFDSFLIQYQESEKVGEAIVLTVPGSERSYDLTGLKPGTEYTVSIYGVHVIIHSGSSNPLSAIFTT

SEQ ID NO: 596 - protein, 98 aa, Artificial
  leukotoxin binding domain Luk717
LPAPKNLVVSRVTEDSARLSWTSRLEDFWFDSFLIQYQESEKVGEAIVLTVPGSERSYDLTGLKPGTEYTVSIYGVGSEVYFRYYEHWSNPLSAIFTT

SEQ ID NO: 597 - protein, 98 aa, Artificial
  leukotoxin binding domain Luk718
LPAPKNLVVSRVTEDSARLSWQVNRNAQFHFDSFLIQYQESEKVGEAIVLTVPGSERSYDLTGLKPGTEYTVSIYGVAHPKLVWFAPPSNPLSAIFTT

SEQ ID NO: 598 - protein, 97 aa, Artificial
  leukotoxin binding domain Luk719
LPAPKNLVVSRVTEDSARLSWTFLEKWFIFDSFLIQYQESEKVGEAIVLTVPGSERSYDLTGLKPGTEYTVSIYGVVKHHDHDPEYPSNPLSAIFTT

SEQ ID NO: 599 - protein, 95 aa, Artificial
  leukotoxin binding domain Luk720
LPAPKNLVVSRVTEDSARLSWRHPRIQGGHFDSFLIQYQESEKVGEAIVLTVPGSERSYDLTGLKPGTEYTVSIYGVIHPFWWSPSNPLSAIFTT

SEQ ID NO: 600 - protein, 95 aa, Artificial
  leukotoxin binding domain Luk721
LPAPKNLVVSRVTEDSARLSWYNAKKITPFFDSFLIQYQESEKVGEAIVLTVPGSERSYDLTGLKPGTEYTVSIYGVYPEVQHTTSNPLSAIFTT

SEQ ID NO: 601 - protein, 91 aa, Artificial
  leukotoxin binding domain Luk722
LPAPKNLVVSRVTEDSARLSWTEPWQEFDSFLIQYQESEKVGEAIVLTVPGSERSYDLTGLKPGTEYTVSIYGVILPTLHKSNPLSAIFTT

SEQ ID NO: 602 - protein, 97 aa, Artificial
  leukotoxin binding domain Luk723
LPAPKNLVVSRVTEDSARLSWYRFPRIHFDSFLIQYQESEKVGEAIVLTVPGSERSYDLTGLKPGTEYTVSIYGVHTNIDLHNYNYLSNPLSAIFTT

SEQ ID NO: 603 - protein, 96 aa, Artificial
  leukotoxin binding domain Luk724
LPAPKNLVVSRVTEDSARLSWAERHPWFDSFLIQYQESEKVGEAIVLTVPGSERSYDLTGLKPGTEYTVSIYGVLRQNINIQDTNYSNPLSAIFTT

SEQ ID NO: 604 - protein, 94 aa, Artificial
  leukotoxin binding domain Luk725
LPAPKNLVVSRVTEDSARLSWPWWEGWTFDSFLIQYQESEKVGEAIVLTVPGSERSYDLTGLKPGTEYTVSIYGVKIRTLKASRSNPLSAIFTT

SEQ ID NO: 605 - protein, 96 aa, Artificial
  leukotoxin binding domain Luk726
LPAPKNLVVSRVTEDSARLSWAANFIDFDSFLIQYQESEKVGEAIVLTVPGSERSYDLTGLKPGTEYTVSIYGVYSPKLRWDLLNYSNPLSAIFTT

SEQ ID NO: 606 - protein, 96 aa, Artificial
  leukotoxin binding domain Luk727
LPAPKNLVVSRVTEDSARLSWFKQEFEFDSFLIQYQESEKVGEAIVLTVPGSERSYDLTGLKPGTEYTVSIYGVYYPEYYPREPWPSNPLSAIFTT

SEQ ID NO: 607 - protein, 92 aa, Artificial
  leukotoxin binding domain Luk728
LPAPKNLVVSRVTEDSARLSWEDEGTQFDSFLIQYQESEKVGEAIVLTVPGSERSYDLTGLKPGTEYTVSIYGVHWYWYWQRSNPLSAIFTT

SEQ ID NO: 608 - protein, 97 aa, Artificial
  leukotoxin binding domain Luk729
LPAPKNLVVSRVTEDSARLSWFGNQTGARSFDSFLIQYQESEKVGEAIVLTVPGSERSYDLTGLKPGTEYTVSIYGVYYQFRRTVRNSNPLSAIFTT

SEQ ID NO: 609 - protein, 98 aa, Artificial
  leukotoxin binding domain Luk730
LPAPKNLVVSRVTEDSARLSWGENRFVLSFDSFLIQYQESEKVGEAIVLTVPGSERSYDLTGLKPGTEYTVSIYGVLYHARHTWWLQQSNPLSAIFTT

SEQ ID NO: 610 - protein, 96 aa, Artificial
  leukotoxin binding domain Luk731
LPAPKNLVVSRVTEDSARLSWEKQQLKKWSFDSFLIQYQESEKVGEAIVLTVPGSERSYDLTGLKPGTGYTVSIYGVEHSNTRKRHSNPLSAIFTT

SEQ ID NO: 611 - protein, 97 aa, Artificial
  leukotoxin binding domain Luk732
LPAPKNLVVSRVTEDSARLSWKINDNSGYFDSFLIQYQESEKVGEAIVLTVPGSERSYDLTGLKPGTEYTVSIYGVAHRYENNPTLWSNPLSAIFTT

SEQ ID NO: 612 - protein, 98 aa, Artificial
  leukotoxin binding domain Luk733
LPAPKNLVVSRVTEDSARLSWPAFRWQPPGFDSFLIQYQESEKVGEAIVLTVPGSERSYDLTGLKPGTEYTVSIYGVGGFLYPWNYPTSNPLSAIFTT

SEQ ID NO: 613 - protein, 99 aa, Artificial
  leukotoxin binding domain Luk734
LPAPKNLVVSRVTEDSARLSWISEKPTTSLFDSFLIQYQESEKVGEAIVLTVPGSERSYDLTGLKPGTEYTVSIYGVWPRAIHYAYWFNSNPLSAIFTT

SEQ ID NO: 614 - protein, 97 aa, Artificial
  leukotoxin binding domain Luk735
LPAPKNLVVSRVTEDSARLSWQKSFQLTPFDSFLIQYQESEKVGEAIVLTVPGSERSYDLTGLKPGTEYTVSIYGVVVEYKWAATNPSNPLSAIFTT

SEQ ID NO: 615 - protein, 94 aa, Artificial
  leukotoxin binding domain Luk736
LPAPKNLVVSRVTEDSARLSWNASLNANHFDSFLIQYQESEKVGEAIVLTVPGSERSYDLTGLKPGTEYTVSIYGVVTSESNYGSNPLSAIFTT

SEQ ID NO: 616 - protein, 96 aa, Artificial
  leukotoxin binding domain Luk737
LPAPKNLVVSRVTEDSARLSWTNTARLNKFDSFLIQYQESEKVGEAIVLTVPGSERSYDLTGLKPGTEYTVSIYGVAITHSHHHHSSNPLSAIFTT

SEQ ID NO: 617 - protein, 89 aa, Artificial
  leukotoxin binding domain Luk738
LPAPKNLVVSRVTEDSARLSWTAPDAAFDSFHILYWEPTPIGEAILLNVPGSERSYDLTGLKPGTEYNVEIDGVKGGNPSDPLSAIFTT

SEQ ID NO: 618 - protein, 89 aa, Artificial
  leukotoxin binding domain Luk739
LPAPKNLVVSRVTEDSARLSWTAPDAAFDSFSISYREGGQHGEAIVLTVPGSERSYDLTGLKPGTEYSVYILGVKGGDESEPLSAIFTT

SEQ ID NO: 619 - protein, 92 aa, Artificial
  leukotoxin binding domain Luk740
LPAPKNLVVSRVTEDSARLSWPWWNKHFDSFLIQYQESEKVGEAIVLTVPGSERSYDLTGLKPGTEYTVSIYGVIQWKKKPFSNPLSAIFTT

SEQ ID NO: 620 - protein, 96 aa, Artificial
  leukotoxin binding domain Luk741
LPAPKNLVVSRVTEDSARLSWPWWNKHFDSFLIQYQESEKVGEAIVLTVPGSERSYDLTGLKPGTEYTVSIYGVGEHDWYLLNYAESNPLSAIFTT

SEQ ID NO: 621 - protein, 96 aa, Artificial
  leukotoxin binding domain Luk742
LPAPKNLVVSRVTEDSARLSWWAFSYLQFDSFLIQYQESEKVGEAIVLTVPGSERSYDLTGLKPGTEYTVSIYGVVEVRENSWNHSSNPLSAIFTT

SEQ ID NO: 622 - protein, 93 aa, Artificial
  leukotoxin binding domain Luk743
LPAPKNLVVSRVTEDSARLSWRETHNPQFDSFLIQYQESEKVGEAIVLTVPGSERSYDLTGLKPGTEYTVSIYGVIQWKKKPFSNPLSAIFTT

SEQ ID NO: 623 - protein, 96 aa, Artificial
  leukotoxin binding domain Luk744
LPAPKNLVVSRVTEDSARLSWTTRVDEFDSFLIQYQESEKVGEAIVLTVPGSERSYDLTGLKPGTEYTVSIYGVKWYNWKKNVNTESNPLSAIFTT

SEQ ID NO: 624 - protein, 96 aa, Artificial
  leukotoxin binding domain Luk745
LPAPKNLVVSRVTEDSARLSWSQKDINFFDSFLIQYQESEKVGEAIVLTVPGSERSYDLTGLKPGTEYTVSIYGVLWYNWKKNWDNSNPLSAIFTT

SEQ ID NO: 625 - protein, 93 aa, Artificial
  leukotoxin binding domain Luk746
LPAPKNLVVSRVTEDSARLSWFTTNNHWFDSFLIQYQESEKVGEAIVLTVPGSERSYDLTGLKPGTEYTVSIYGVIQWKKKPFSNPLSAIFTT

SEQ ID NO: 626 - protein, 94 aa, Artificial
  leukotoxin binding domain Luk747
LPAPKNLVVSRVTEDSARLSWGRAREPASFDSFLIQYQESEKVGEAIVLTVPGSERSYDLTGLKPGTEYTVSIYGVLTVLFIDSSNPLSAIFTT

SEQ ID NO: 627 - protein, 98 aa, Artificial
  leukotoxin binding domain Luk748
LPAPKNLVVSRVTEDSVRLSWYNWKKKRLKFDSFLIQYQESEKVGEAIVLTVPGSERSYDLTGLKPGTEYTVSIYGVPNLWDIWNWVLSNPLSAIFTT

SEQ ID NO: 628 - protein, 95 aa, Artificial
  leukotoxin binding domain Luk749
LPAPKNLVVSRVTEDSARLSWGTFNLEVYIFDSFLIQYQESEKVGEAIVLTVPGSERSYDLTGLKPGTEYTVSIYGVVSANWHGHSNPLSAIFTT

SEQ ID NO: 629 - protein, 97 aa, Artificial
  leukotoxin binding domain Luk750
LPAPKNLVVSRVTEDSARLSWPQIFNELWEFDSFLIQYQESEKVGEAIVLTVPGSERSYDLTGLKPGTEYTVSIYGVWWYNRKKKRQSNPLSAIFTT

SEQ ID NO: 630 - protein, 97 aa, Artificial
  leukotoxin binding domain Luk751
LPAPKNLVVSRVTEDSARLSWYNEQKKPINFDSFLIQYQESEKVGEAIVLTVPGSERSYDLTGLKPGTEYTVSIYGVWWYNRKKKRQSNPLSAIFTT

SEQ ID NO: 631 - protein, 97 aa, Artificial
  leukotoxin binding domain Luk752
LPAPKNLVVSRVTEDSARLSWRGKYSVVDFDSFLIQYQESEKVGEAIVLTVPGSERSYDLTGLKPGTEYTVSIYGVPWYNWKKKYVISNPLSAIFTT

SEQ ID NO: 632 - protein, 96 aa, Artificial
  leukotoxin binding domain Luk753
LPAPKNLVVSRVTEDSARLSWYNTKKNPVFDSFLIQYQESEKVGEAIVLTVPGSERSYDLTGLKPGTEYTVSIYGVWLIKSLNAWFSNPLSAIFTT

SEQ ID NO: 633 - protein, 89 aa, Artificial
  leukotoxin binding domain Luk754
LPAPKNLVVSRVTEDSARLSWTAPDAAFDSFVIIYEEVQWRGEAIRLFVPGSERSYDLTGLKPGTEYDVNIRGVKGGGSSAPLSAIFTT

SEQ ID NO: 634 - protein, 95 aa, Artificial
  leukotoxin binding domain Luk755
LPAPKNLVVSRVTEDSARLSWYNWKKKPGYFDSFLIQYQESEKVGEAIVLTVPGSERSYDLTGLKPGTEYTVSIYGVVHYHEWLASNPLSAIFTT

SEQ ID NO: 635 - protein, 99 aa, Artificial
  leukotoxin binding domain Luk756
LPAPKNLVVSRVTEDSARLSWYTVKKKPQKFDSFLIQYQESEKVGEAIVLTVPGSERSYDLTGLKPGTEYTVSIYGVLDAYPIAEWPAQSNPLSAIFTT

SEQ ID NO: 636 - protein, 95 aa, Artificial
  leukotoxin binding domain Luk757
LPAPKNLVVSRVTEDSARLSWYNTKKKPQFDSFLIQYQESEKVGEAIVLTVPGSERSYDLTGLKPGTEYTVSIYGVNEFILRWEGSNPLSAIFTT

SEQ ID NO: 637 - protein, 89 aa, Artificial
  leukotoxin binding domain Luk758
LPAPKNLVVSRVTEDSARLSWTAPDAAFDSFYIGYYELIGAGEAIVLTVPGSERSYDLTGLKPGTEYGVGIQGVKGGSYSAPLSAIFTT

SEQ ID NO: 638 - protein, 95 aa, Artificial
  leukotoxin binding domain Luk759
LPAPKNLVVSRVTEDSARLSWYDRKVEFDSFLIQYQESEKVGEAIVLTVPGSERSYDLTGLKPGTEYTVSIYGVGVDGWGYLLLVSNPLSAIFTT

SEQ ID NO: 639 - protein, 96 aa, Artificial
  leukotoxin binding domain Luk760
LPAPKNLVVSRVTEDSARLSWIVPRTFHFDSFLIQYQESEKVGEAIVLTVPGSERSYDLTGLKPGTEYTVSIYGVWSQYITHWLPKSNPLSAIFTT

SEQ ID NO: 640 - protein, 90 aa, Artificial
  leukotoxin binding domain Luk761
LPAPKNLVVSRVTEDSARLSWNYRVATFDSFLIQYQESEKVGEAIVLTVPGSERSYDLTGLKPGTEYTVSIYGVSVELLSSNPLSAIFTT

SEQ ID NO: 641 - protein, 95 aa, Artificial
  leukotoxin binding domain Luk762
LPAPKNLVVSRVTEDSARLSWQPHRYEFYQFDSFLIQYQESEKVGEAIVLTVPGSERSYDLTGLKPGTEYTVSIYGVADFEFELHSNPLSAIFTT

SEQ ID NO: 642 - protein, 95 aa, Artificial
  leukotoxin binding domain Luk763
LPAPKNLVVSRVTEDSARLSWIPSYHLFAFDSFLIQYQESEKVGEAIVLTVPGSERSYDLTGLKPGTEYTVSIYGVNDAEQRYHHSNPLSAIFTT

SEQ ID NO: 643 - protein, 95 aa, Artificial
  leukotoxin binding domain Luk764
LPAPKNLVVSRVTEDSARLSWPINKTTSPFDSFLIQYQESEKVGEAIVLTVPGSERSYDLTGLKPGTEYTVSIYGVVEAHYDAFISNPLSAIFTT

SEQ ID NO: 644 - protein, 96 aa, Artificial
  leukotoxin binding domain Luk765
LPAPKNLVVSRVTEDSARLSWRKKLWEAEFDSFLIQYQESEKVGEAIVLTVPGSERSYDLTGLKPGTEYTVSIYGVILPDSFHVHHCNPLSAIFTT

SEQ ID NO: 645 - protein, 95 aa, Artificial
  leukotoxin binding domain Luk766
LPAPKNLVVSRVTEDSARLSWKRPQWRRLFDSFLIQYQESEKVGEAIVLTVPGSERSYDLTGLKPGTEYTVSIYGVGVNWPASVSSNPLSAIFTT

SEQ ID NO: 646 - protein, 95 aa, Artificial
  leukotoxin binding domain Luk767
LPAPKNLVVSRVTEDSARLSWIWDAIGPHFFDSFLIQYQESEKVGEAIVLTVPGSERSYDLTGLKPGTEYTVSIYGVSWFIRITASNPLSAIFTT

SEQ ID NO: 647 - protein, 98 aa, Artificial
  leukotoxin binding domain Luk768
LPAPKNLVVSRVTEDSARLSWRGLEPRWGFDSFLIQYQESEKVGEAIVLTVPGSERSYDLTGLKPGTEYTVSIYGVPWYEHLRILNATSNPLSAIFTT

SEQ ID NO: 648 - protein, 97 aa, Artificial
  leukotoxin binding domain Luk769
LPAPKNLVVSRVTEDSARLSWDWWSNPIKFDSFLIQYQESEKVGEAIVLTVPGSERSYDLTGLKPGTEYTVSIYGVINWHWYQTHRTSNPLSAIFTT

SEQ ID NO: 649 - protein, 99 aa, Artificial
  leukotoxin binding domain Luk770
LPAPKNLVVSRVTEDSARLSWEQWHAGVNPFDSFLIQYQESEKVGEAIVLTVPGSERSYDLTGLKPGTEYTVSIYGVSYYVRVLQFALFSNPLSAIFTT

SEQ ID NO: 650 - protein, 96 aa, Artificial
  leukotoxin binding domain Luk771
LPAPKNLVVSRVTEDSARLSWAQVETQIHFDSFLIQYQESEKVGESDLLTVPGSERSYDLTGLKPGTEYTVSIYGVSHYRRHVPRHSNPLSAIFTT

SEQ ID NO: 651 - protein, 97 aa, Artificial
  leukotoxin binding domain Luk772
LPAPKNLVVSRVTEDSARLSWIAYYYGQTFDSFLIQYQESEKVGEAIVLTVPGSERSYDLTGLKPGTEYTVSIYGVWHENYAKWPDPSNPLSAIFTT

SEQ ID NO: 652 - protein, 98 aa, Artificial
  leukotoxin binding domain Luk773
LPAPKNLVVSRVTEDSARLSWWHWLTHHFFDSFLIQYQESEKVGEAIVLTVPGSERSYDLTGLKPGTEYTVSIYGVFFRWQDPLHDLISNPLSAIFTT

SEQ ID NO: 653 - protein, 94 aa, Artificial
  leukotoxin binding domain Luk774
LPAPKNLVVSRVTEDSARLSWKYKEHFQIFDSFLIQYQESEKVGEAIVLTVPGSERSYDLTGLKPGTEYTVSIYGVERIWWQYRSNPLSAIFTT

SEQ ID NO: 654 - protein, 95 aa, Artificial
  leukotoxin binding domain Luk775
LPAPKNLVVSRVTEDSARLSWVGDAYFNHLFDSFLIQYQESEKVGEAIVLTVPGSERSYDLTGLKPGTEYTVSIYGVEARPKPRLSNPLSAIFTT

SEQ ID NO: 655 - protein, 92 aa, Artificial
  leukotoxin binding domain Luk776
LPAPKNLVVSRVTEDSARLSWNKRVPNFDSFLIQYQESEKVGEAIVLTVPGSERSYDLTGLKPGTEYTVSIYGVIQWKKKPFSNPLSAIFTT

SEQ ID NO: 656 - protein, 97 aa, Artificial
  leukotoxin binding domain Luk777
LPAPKNLVVSRVTEDSARLSWYNEQKKRSFFDSFLIQYQESEKVGEAIVLTVPGSERSYDLTGLKPGTEYTVSIYGVPIRRSGWDVRSNPLSAIFTT

SEQ ID NO: 657 - protein, 96 aa, Artificial
  leukotoxin binding domain Luk778
LPAPKNLVVSRVTEDSARLSWYNTKKKPVFDSFLIQYQESEKVGEAIVLTVPGSERSYDLTGLKPGTEYTVSIYGVKVDDWPDYWQSNPLSAIFTT

SEQ ID NO: 658 - protein, 96 aa, Artificial
  leukotoxin binding domain Luk779
LPAPKNLVVSRVTEDSARLSWYNVKKTFQFDSFLIQYQESEKVGEAIVLTVPGSERSYDLTGLKPGTEYTVSIYGVAAVWYTPNTQSNPLSAIFTT

SEQ ID NO: 659 - protein, 97 aa, Artificial
  leukotoxin binding domain Luk780
LPAPKNLVVSRVTEDSARLSWYNSKKKVQFDSFLIQYQESEKVGEAIVLTVPGSERSYDLTGLKPGTEYTVSIYGVIESHWWQLKWPSNPLSAIFTT

SEQ ID NO: 660 - protein, 97 aa, Artificial
  leukotoxin binding domain Luk781
LPAPKNLVVSRVTEDSARLSWYNTKKKTAFFDSFLIQYQESEKVGEAIVLTVPGSERSYDLTGLKPGTEYTVSIYGVDEVGYLHIETSNPLSAIFTT

SEQ ID NO: 661 - protein, 98 aa, Artificial
  leukotoxin binding domain Luk782
LPAPKNLVVSRVTEDSARLSWYNEKKIFQFDSFLIQYQESEKVGEAIVLTVPGSERSYDLTGLKPGTEYTVSIYGAKGPNFPSQNDPSSNPLSAIFTT

SEQ ID NO: 662 - protein, 98 aa, Artificial
  leukotoxin binding domain Luk783
LPAPKNLVVSRVTEDSARLSWYNWKKKRLKFDSFLIQYQESEKVGEAIVLTVPGSERSYDLTGLKPGTEYTVSIYGVASPVYTGLYLGSNPLSAIFTT

SEQ ID NO: 663 - protein, 98 aa, Artificial
  leukotoxin binding domain Luk784
LPAPKNLVVSRVTEDSARLSWYTVKKKPQKFDSFLIQYQESEKVGEAIVLTVPGSERSYDLTGLKPGTEYTVSIYGVGDQLLEIGRTGSNPLSAIFTT

SEQ ID NO: 664 - protein, 89 aa, Artificial
  leukotoxin binding domain Luk785
LPAPKNLVVSRVTEDSARLSWTAPDAAFDSFFIGYREVPFLGEAIVLTVPGSERSYDLTGLKPGTEYIVLIWGVKGGIPSQPLSAIFTT

SEQ ID NO: 665 - protein, 89 aa, Artificial
  leukotoxin binding domain Luk786
LPAPKNLVVSRVTEDSARLSWTAPDAAFDSFFIPYREEAPLGEAIVLTVPGSERSYDLTGLKPGTEYDVIIVGVKGGYPSKPLSAIFTT

SEQ ID NO: 666 - protein, 89 aa, Artificial
  leukotoxin binding domain Luk787
LPAPKNLVVSRVTEDSARLSWTAPDAAFDSFWIVYHELVHSGEAIVLTVPGSERSYDLTGLKPGTEYPVFIVGVKGGWYSPPLSAIFTT

SEQ ID NO: 667 - protein, 89 aa, Artificial
  Tencon library TCL24
  MISC_FEATURE (32)..(32): Xaa is any amino acid
  MISC_FEATURE (34)..(34): Xaa is any amino acid
  MISC_FEATURE (36)..(36): Xaa is any amino acid
  MISC_FEATURE (38)..(41): Xaa is any amino acid
  MISC_FEATURE (46)..(46): Xaa is any amino acid
  MISC_FEATURE (48)..(48): Xaa is any amino acid
  MISC_FEATURE (68)..(68): Xaa is any amino acid
  MISC_FEATURE (70)..(70): Xaa is any amino acid
  MISC_FEATURE (72)..(72): Xaa is any amino acid
  MISC_FEATURE (78)..(79): Xaa is any amino acid
  MISC_FEATURE (81)..(81): Xaa is any amino acid
  MISC_FEATURE (84)..(84): Xaa is any amino acid
  MISC_FEATURE (86)..(86): Xaa is any amino acid
LPAPKNLVVSRVTEDSARLSWTAPDAAFDSFXIXYXEXXXXGEAIXLXVPGSERSYDLTGLKPGTEYXVXIXGVKGGXXSXPLXAXFTT

We claim:

1. A binding molecule comprising:
a first binding domain capable of binding to a glycosylated staphylococcal surface protein, said first binding domain comprising a variable domain of an immunoglobulin heavy chain, wherein said immunoglobulin heavy chain comprises an amino acid sequence of SEQ ID NO: 60, 62, 64 or 66; and
a second binding domain coupled to said first binding domain and comprising a fibronectin type III (FN3) domain that is capable of binding to a staphylococcal leukotoxin.

2. The binding molecule of claim 1, wherein the glycosylated staphylococcal surface protein is a glycosylated serine-aspartate dipeptide repeat (SDR) containing protein.

3. The binding molecule of claim 2, wherein the glycosylated SDR-containing protein is ClfA, ClfB, SdrC, SdrD, SdrE, SdrF, SdrG or SdrH.

4. The binding molecule of claim 1, wherein the first binding domain is a full-length antibody or an antigen binding fragment thereof.

5. The binding molecule of claim 4, wherein the full-length antibody or antigen binding fragment thereof is resistant to proteolytic degradation by a staphylococcal protease that cleaves wild-type IgG1.

6. The binding molecule of claim 4, wherein the full-length antibody or antigen binding fragment thereof is not capable of specific binding to human FcγRI.

7. The binding molecule of claim 4, wherein the full-length antibody or antigen binding fragment thereof is not capable of specific binding to Protein A.

8. The binding molecule of claim 4, wherein the full-length antibody or antigen binding fragment thereof is not capable of specific binding to Sbi.

9. The binding molecule of claim 4, wherein the full-length antibody or antigen binding fragment thereof is capable of specific binding to FcRn.

10. The binding molecule of claim 1, wherein the FN3 domain binds to LukA having the amino acid sequence of SEQ ID NO:10, LukB having the amino acid sequence of SEQ ID NO:11, LukD having the amino acid sequence of SEQ ID NO:12, LukE having the amino acid sequence of SEQ ID NO:13, or any combination thereof.

11. The binding molecule of claim 1, wherein said staphylococcal leukotoxin is selected from the group consisting of leukotoxin A (LukA), leukotoxin B (LukB), leukotoxin AB (LukAB), leukotoxin D (LukD), leukotoxin E (LukE), leukotoxin ED (LukED), Panton-Valentine leukocidin S (LukS-PV), Panton-Valentine leukocidin F (LukF-PV), Panton-Valentine leukocidin (LukSF/PVL), gamma hemolysin A (HlgA), gamma hemolysin C (HlgC), gamma hemolysin B (HlgB), gamma hemolysin AB (HlgAB), and gamma-hemolysin BC (HlgBC).

12. The binding molecule of claim 1, wherein the first and the second binding domains are connected via a linker peptide.

13. The binding molecule according to claim 1, wherein the first binding domain comprises an immunoglobulin heavy chain having the amino acid sequence of SEQ ID NO:60, 62, 64 or 66.

14. The binding molecule according to claim 1, wherein the first binding domain further comprises a variable domain of an immunoglobulin light chain, wherein said immunoglobulin light chain comprises the amino acid sequence of SEQ ID NO:61, 63, 65 or 67.

15. The binding molecule of claim 1, wherein the first binding domain comprises:
   a heavy chain having the amino acid sequence of SEQ ID NO:60, 62, 64 or 66 and
   a light chain having the amino acid sequence of SEQ ID NO:61, 63, 65 or 67.

16. The binding molecule according to claim 1, wherein the first binding domain comprises:
   (1) a heavy chain having the amino acid sequence of SEQ ID NO:60, and a light chain having the amino acid sequence of SEQ ID NO:61;
   (2) a heavy chain having the amino acid sequence of SEQ ID NO:62, and a light chain having the amino acid sequence of SEQ ID NO:63;
   (3) a heavy chain having the amino acid sequence of SEQ ID NO:64, and a light chain having the amino acid sequence of SEQ ID NO:65; or
   (4) a heavy chain having the amino acid sequence of SEQ ID NO:66, and a light chain having the amino acid sequence of SEQ ID NO:67.

17. The binding molecule of claim 1, wherein the first binding domain comprises (i) a heavy chain having the amino acid sequence of SEQ ID NO:60, 62, 64 or 66; and (ii) a light chain having the amino acid sequence of SEQ ID NO:61, 63, 65 or 67; and the second binding domain comprises the amino acid sequence of any one of SEQ ID NOs:14-59 or SEQ ID NOs:113-666.

18. The binding molecule of claim 1 further comprising:
   one or more additional binding domains, said additional binding domains capable of (i) binding to a different glycosylated staphylococcal surface protein than bound by the first binding domain and/or (ii) binding to a different staphylococcal leukotoxin than bound by the second binding domain.

19. A pharmaceutical composition comprising:
   the binding molecule according to claim 1 and
   a pharmaceutically acceptable carrier.

20. A method for the treatment, or amelioration of a staphylococcal infection, comprising:
   administering to a subject in need thereof the binding molecule according to claim 1 under conditions effective to treat or ameliorate the staphylococcal infection.

21. A method for diagnosing a staphylococcal infection in a subject comprising:
   contacting the binding molecule according to claim 1, with a sample from the subject;
   detecting presence or absence of a glycosylated staphylococcal surface protein and/or a staphylococcal leukotoxin in the sample based on said contacting; and
   diagnosing the staphylococcal infection in the subject based on said detecting.

22. A method for the detection of *staphylococcus* in a sample, comprising:
   contacting the binding molecule according to claim 1 with the sample;
   detecting presence or absence of a glycosylated *staphylococcus* surface protein and/or a staphylococcal leukotoxin in the sample based on said contacting, whereby the presence of the glycosylated *staphylococcus* surface protein and/or staphylococcal leukotoxin indicates the presence of *staphylococcus* in the sample.

23. A method for the treatment or amelioration of a staphylococcal infection in a subject, comprising:
   contacting the binding molecule according to claim 1 with a sample from the subject;
   detecting a glycosylated staphylococcal surface protein and/or a staphylococcal leukotoxin in the sample based on said contacting; and
   administering an agent suitable for treating or ameliorating staphylococcal infection to the subject based on said detecting.

24. A kit comprising a binding molecule of claim 1.

* * * * *